US010428332B2

(12) United States Patent
Capon

(10) Patent No.: US 10,428,332 B2
(45) Date of Patent: Oct. 1, 2019

(54) HYBRID IMMUNOGLOBULINS WITH MOVING PARTS

(71) Applicant: Daniel Capon, Hillsborough, CA (US)

(72) Inventor: Daniel Capon, Hillsborough, CA (US)

(*) Notice: Subject to any disclaimer, the term of this patent is extended or adjusted under 35 U.S.C. 154(b) by 0 days.

(21) Appl. No.: 15/198,475

(22) Filed: Jun. 30, 2016

(65) Prior Publication Data

US 2016/0376601 A1 Dec. 29, 2016

Related U.S. Application Data

(63) Continuation of application No. 11/982,085, filed on Oct. 31, 2007, now abandoned.

(60) Provisional application No. 60/856,864, filed on Nov. 2, 2006.

(51) Int. Cl.
| | | |
|---|---|---|
| *C07K 16/00* | (2006.01) | |
| *C07K 1/00* | (2006.01) | |
| *C12N 15/62* | (2006.01) | |
| *A61K 51/10* | (2006.01) | |
| *A61K 47/68* | (2017.01) | |

(52) U.S. Cl.
CPC ........ *C12N 15/625* (2013.01); *A61K 47/6835* (2017.08); *A61K 47/6875* (2017.08); *A61K 51/1084* (2013.01); *C12N 15/62* (2013.01); *C07K 2317/52* (2013.01); *C07K 2319/30* (2013.01)

(58) Field of Classification Search
None
See application file for complete search history.

(56) References Cited

U.S. PATENT DOCUMENTS

| | | | |
|---|---|---|---|
| 4,179,337 A | 12/1979 | Davis et al. | |
| 4,301,144 A | 11/1981 | Iwashita et al. | |
| 4,378,347 A | 3/1983 | Franco | |
| 4,399,216 A | 8/1983 | Axel et al. | |
| 4,496,689 A | 1/1985 | Mitra | |
| 4,640,835 A | 2/1987 | Shimuzi et al. | |
| 4,670,417 A | 6/1987 | Iwasaki et al. | |
| 4,774,322 A | 9/1988 | Seyedin et al. | |
| 4,791,192 A | 12/1988 | Nakagawa et al. | |
| 4,877,864 A | 10/1989 | Wang | |
| 4,943,529 A | 7/1990 | Van den Berg et al. | |
| 4,946,783 A | 8/1990 | Beckwith et al. | |
| 5,010,182 A | 4/1991 | Brake et al. | |
| 5,116,964 A | 5/1992 | Capon et al. | |
| 5,336,603 A | 8/1994 | Capon et al. | |
| 5,359,046 A | 10/1994 | Capon et al. | |
| 5,364,934 A | 11/1994 | Drayna et al. | |
| 5,519,115 A | 5/1996 | Mepelli et al. | |
| 5,536,637 A | 7/1996 | Jacobs | |
| 5,686,279 A | 11/1997 | Finer et al. | |
| 5,834,247 A * | 11/1998 | Comb ............ | C07K 1/1075 435/252.3 |
| 5,838,464 A | 11/1998 | Fredlund et al. | |
| 6,184,344 B1 | 2/2001 | Kent et al. | |
| 6,723,535 B2 | 4/2004 | Ashkenazi et al. | |
| 6,849,428 B1 | 2/2005 | Evans et al. | |
| 6,897,285 B2 | 5/2005 | Xu et al. | |
| 7,259,015 B2 | 8/2007 | Kingsman et al. | |
| 7,312,195 B2 | 12/2007 | Craik et al. | |
| 2004/0009498 A1 | 1/2004 | Short | |
| 2004/0265921 A1* | 12/2004 | Lesaicherre ..... | G01N 33/54353 435/7.5 |
| 2005/0027109 A1 | 2/2005 | Mezo et al. | |
| 2005/0032174 A1* | 2/2005 | Peters ............ | C07K 14/475 435/69.7 |
| 2005/0100987 A1 | 5/2005 | Evans et al. | |
| 2005/0125860 A1 | 6/2005 | Raab | |
| 2005/0260194 A1 | 11/2005 | Peters et al. | |
| 2006/0199180 A1 | 9/2006 | Macina et al. | |
| 2008/0254512 A1 | 10/2008 | Capon | |

FOREIGN PATENT DOCUMENTS

| | | |
|---|---|---|
| DE | 266710 | 4/1989 |
| EP | 36776 | 9/1981 |
| EP | 73657 | 3/1983 |
| EP | 117058 | 8/1984 |
| EP | 117060 | 8/1984 |
| EP | 0 125 023 | 11/1984 |
| EP | 139383 | 5/1985 |
| EP | 169016 | 1/1986 |
| EP | 0 173 494 | 3/1986 |
| EP | 183070 | 6/1986 |
| EP | 200341 | 12/1986 |
| EP | 244234 | 11/1987 |
| EP | 267463 | 5/1988 |
| EP | 268561 | 5/1988 |
| EP | 0325 224 A2 | 7/1989 |

(Continued)

OTHER PUBLICATIONS

Rothlisberger et al. (Journal of molecular Biology, 2005, 347:773-789).*
Wright et al. (Trends in Biotech, 1997, 15:26-32).*
Wiersma et al. (The Journal of Immunology, 1995, 154:5265-5272).*
Kan et al. (Journal of Immunology, 2001, 166:1320-1326).*
Nishida (International Journal of Oncology, 31, 2007:29-40).*
Shalaby et al. (Journal of Experimental Medicine, 1992, 175:217-225).*

(Continued)

*Primary Examiner* — Julie Wu

(74) *Attorney, Agent, or Firm* — John P. White; Cooper & Dunham LLP

(57) ABSTRACT

Hybrid immunoglobulins containing moving parts are provided as well as related compositions and methods of use and methods of production. In addition, analogous genetic devices are provided as well as related compositions and methods of use and methods of production.

19 Claims, 89 Drawing Sheets

Specification includes a Sequence Listing.

(56) References Cited

FOREIGN PATENT DOCUMENTS

| | | |
|---|---|---|
| EP | 362179 | 4/1990 |
| EP | 394538 | 10/1990 |
| EP | 402226 | 12/1990 |
| GB | 2211504 | 7/1989 |
| JP | 5519287 | 6/2014 |
| WO | WO 84/03564 | 9/1984 |
| WO | WO 87/05330 | 9/1987 |
| WO | WO 88/00205 | 1/1988 |
| WO | WO 90/13646 | 11/1990 |
| WO | WO 91/00357 | 1/1991 |
| WO | WO 00/00625 | 1/2000 |
| WO | WO 01/57183 | 8/2001 |

OTHER PUBLICATIONS

Altschul, S.F. and Gish, W., "Local Alignment Statistics," Methods in Enzymology 266:460-480 (1996).
Carter, P. et al., "Improved oligonucleotide site-directed mutagenesis using M13 vectors," Nucl. Acids Res., 13(12):4431-4443 (1985).
Zoller, M.J. and Smith, M., "Oligonucleotide-directed mutagenesis using M13-derived vectors: an efficient and general procedure for the production of point mutation in any fragment of DNA," Nucl. Acids Res., 10(20):6487-6500 (1982).
Wells, J. et al., "Cassette mutagenesis: an efficient method for generation of multiple mutations at defined sites," Gene, 34:315-323 (1985).
Wells, J. et al., "Importance of hydrogen-bond formation in stabilizing the transition state of subtilisin," Philos. Trans. R. Soc. London, 317:415-423 (1986).
Cunningham, B. and Wells, J., "High-Resolution Epitope Mapping of hGH-Receptor Interactions by Alanine-Scanning Mutagenesis," Science, 244:1081-1085 (1989).
Chothia, C., "The Nature of the Accessible and Buried Surfaces in Proteins," J. Mol. Biol., 105:1-14 (1976).
Creighton, T. E. (1983) "Proteins: Structure and Molecular Properties," New York: W.H. Freeman & Co., pp. 70-86.
Aplin, J.D. and Wriston, J.C. (1981) "Preparation, Properties, and Applications of Carbohydrate Conjugates of Proteins and Lipids," CRC Crit. Rev. Biochem., Maryland: John Hopkins University, pp. 259-306.
Sojar, H.T. and Bahl, O.P., "A Chemical Method for the Deglycosylation of Proteins," Arch. Biochem. Biophys., 259(1):52-57 (1987).
Edge, A.S.B. et al., "Deglycosylation of Glycoproteins by Trifluoromethanesulfonic Acid," Anal. Biochem., 118:131-137 (1981).
Thotakura, N. R. and Bahl, O.P., "Enzymatic Deglycosylation of Glycoproteins," Meth. Enzymol., 138:350-359 (1987).
Field, J. et al., "Purification of a RAS-Responsive Adenylyl Cyclase Complex from *Saccharomyces cerevisiae* by Use of an Epitope Addition Method," Mol. Cell. Biol., 8(5):2159-2165 (1988).
Evan, G.I. et al., "Isolation of Monoclonal Antibodies Specific for Human c-myc Proto-Oncogene Product," Molecular and Cellular Biology, 5(12):3610-3616 (1985).
Paborsky, L.R. et al., "Mammalian cell transient expression of tissue factor for the production of antigen," Protein Engineering, 3(6):547-553 (1990).
Hopp, T.P. et al., "A short polypeptide marker sequence useful for recombinant protein identification and purification," Biotechnology, 6:1204-1210 (1988).
Martin, G.A. et al., "GAP Domains Responsible for Ras p21-Dependent Inhibition of Muscarinic Atrial K+ Channel Currents," Science, 255:192-194 (1992).
Skinner, R.H. et al., "Use of the Glu-Glu-Phe C-terminal Epitope for Rapid Purification of the Catalytic Domain of Normal and Mutant ras GTPase-activating Proteins," J. Biol. Chem., 266(22):14163-14166 (1991).
Lutz-Freyermuth, C. et al., "Quantitative determination that one of two potential RNA-binding domains of the A protein component of the U1 small nuclear ribonucleoprotein complex binds with high affinity to stem-loop II of U1 RNA," Proc. Natl. Acad. Sci. USA, 87:6393-6397 (1990).
Robinson, J. R. (1978) "Sustained and Controlled Release Drug Delivery Systems," New York: Marcel Dekker, Inc., pp. 71-121.
Munro, A., "Use of chimaeric antibodies," Nature, 312:597 (1984).
Neuberger, M.S. et al., "Recombinant antibodies possessing novel effector functions," Nature, 312:604-608 (1984).
Sharon, J. et al., "Expression of a VHCK chimaeric protein in mouse myeloma cells," Nature, 309:364-367 (1984).
Morrison, S.L. et al., "Chimeric human antibody molecules: Mouse antigen-binding domains with human constant region domains," Proc. Natl. Acad. Sci. USA, 81:6851-6855 (1984).
Morrison, S.L. et al., "Transfectomas Provide Novel Chimeric Antibodies," Science 229:1202-1207 (1985).
Boulianne, G.L. et al., "Production of functional chimaeric mouse/human antibody," Nature 312:643-646 (1984).
Capon, D.J. et al., "Designing CD4 immunoadhesins for AIDS therapy," Nature, 337:525-531, (1989).
Traunecker, A. et al., "Highly effective neutralization of HIV with recombinant CD4-immunoglobulin molecules," Nature, 339:68-70 (1989).
Gascoigne, N.R.J. et al., "Secretion of a chimeric T-cell receptor-immunoglobulin protein," Proc. Nat. Acad. Sci. USA, 84:2936-2940 (1987).
Zapata, G. et al., "Engineering linear F(ab')2 fragments for efficient production in *Eschericchia coli* and enhanced antiproliferative activity," Protein Eng. 8(10): 1057-1062 (1995).
Pluckthun, A. (1994) "Antibodies from *Escherichia coli*," in The Pharmacology of Monoclonal Antibodies, Rosenburg, M. and Moore, G.P. eds., New York: Springer-Verlag, vol. 113, pp. 269-315.
Klein, R.D. et al., "Selection for genes encoding secreted proteins and receptors," Proc. Natl. Acad. Sci., 93:7108-7113 (1996).
Plata-Salamán, C.R., "Epidermal Growth Factor and the Nervous System," Peptides, 12:653-663 (1991).
Stoscheck, C.M. and King, L.E., "Functional and Structural Characteristics of EGF and Its Receptor and Their Relationship to Transforming Proteins," J. Cell Biochem. 31:135-152 (1986).
Savage, C.R. et al., "Epidermal Growth Factor: Location of Disulfide Bonds," J. Biol. Chem. 248(22):7669-7672 (1973).
Reisner, A.H., "Similarity between the vaccinia virus 19K early protein and epidermal growth factor," Nature, 313:801-803 (1985).
Chang, W. et al., "The Genome of Shope Fibroma Virus, a Tumorigenic Poxvirus, Contains a Growth Factor Gene with Sequence Similarity to Those Encoding Epirdermal Growth Factor and Transforming Growth Factor Alpha," Mol. Cell Biol. 7(1):535-540 (1987).
Porter, C.D. and Archard, L.C., "Characterization and Physical Mapping of Molluscum contagiosum Virus DNA and Location of a Sequence Capable of Encoding a Conserved Domain of Epidermal Growth Factor," J. Gen. Virol. 68:673-682 (1987).
Upton, C. et al., "Mapping and Sequencing of a Gene from Myxoma Virus That Is Related to Those Encoding Epidermal Growth Factor and Transforming Growth Factor Alpha," J. Virol., 61(4):1271-1275 (1987).
Prigent, S.A. and Lemoine, N.R., "The Type 1 (EGFR-Related) Family of Growth Factor Receptors and Their Ligands," Prog. Growth Factor Res. 4:1-24 (1992).
Laurence, D.J.R. and Gusterson, B.A., "The Epidermal Growth Factor/A Review of Structural and Functional Relationships in the Normal Organism and in Cancer Cells," Tumor Biol. 11:229-261 (1990).
Wharton, K.A. et al., "Nucleotide Sequence from the Nuerogenic Locus Notch Implies a Gene Product That Shares Homology with Proteins Containing EGF-like Repeats," Cell 43:567-581 (1985).
Konturek, P.C. et al., "Epideral growth factor and transforming growth-factor-alpha:role in protection and healing of gastric mucosal lesions," Eur. J. Gastroenterology Hepatol., 7(10), 933-398 (1995).
Guglietta, A. and Sullivan, P.B., "Clinical applications of epidermal growth factor," Eur. J. Gastroenterology Hepatol., 7(10), 945-950 (1995).
Du Cros, D.L., "Fibroblast Growth Factor and Epidermal Growth Factor in Hair Development," J. Invest. Dermatol., 101(1 Suppl.), 106S-113S (1993).

(56) References Cited

OTHER PUBLICATIONS

Hillier, S.G., "A Role for Epidermal Growth Factor in the Follicular Paracrine System," Clin. Endocrinol. 33(4), 427-428 (1990).

Hamm, L.L. et al., "Epidermal Growth Factor and the Kidney," Semin. Nephrol. 13(1): 109-115 (1993).

Harris, R.C., "Potential Physiologic Roles for Epidermal Growth Factor in the Kidney," Am. J. Kidney Dis. 17(6): 627-630 (1991).

van Setten, G.B. et al., "Epidermal growth factor in human tear fluid: A minireview," Int. Ophthalmol., 15:359-362 (1991).

Stenflo, J., Structure-Function Relationships of Epidermal Growth Factor Modules in Vitamin K-Dependent Clotting Factors, Blood, 78(7):1637-1651 (1991).

King, L.E. et al., "The Role of Epidermal Growth Factor in Skin Diseases," Am. J. Med. Sci., 296(3):154-158 (1988).

Aaronson, S.A., "Growth Factors and Cancer," Science, 254:1146-1153 (1991).

Gullick, W.J. (1988) "A comparison of the structures of single polypeptide chain growth factor receptors that possess protein tyrosine kinase activity," in Hormones and their Actions, Part II, Cooke, B.A. et al. eds., Amsterdam: Elsevier Science Publishers B.V., pp. 349-360.

Gospodarowicz, D. et al., "Isolation of brain fibroblast growth factor by heparin-Sepharose affinity chromatography: Identity with pituitary fibroblast growth factor," Proc. Nat. Acad. Sci. USA, 81:6963-6967 (1984).

Baird, A. and Böhlen, P. (1990) "Fibroblast Growth Factors," in Handbook of Exp. Pharmacol., Berlin: Springer-Verlag; 95(1):369-418.

Tanaka, A. et al., "Cloning and characterization of an androgen-induced growth factor essential for the androgen-dependent growth of mouse mammary carcinoma cells," Proc. Natl. Acad. Sci. USA, 89:8928-8932 (1992).

Sato, B. et al., "Androgen-Induced Growth Factor and Its Receptor: Demonstration of the Androgen-Induced Autocrine Loop in Mouse Mammary Carcinoma Cells," J. Steroid Biochem. Molec. Biol. 47(1-6):91-98 (1993).

Kouhara, H. et al., "Transforming activity of a newly cloned androgen-induced growth factor," Oncogene, 9: 455-462 (1994).

Schmitt, J.F., et al., "Expression of Fibroblast Growth Factor-8 in Adult Rat Tissues and Human Prostate Carcinoma Cells," J. Steroid Biochem. Mol. Biol., 57 (3/4):173-178 (1996).

Shackleford, G.M. et al., "Mouse mammary tumor virus infection accelerates mammary carcinogenesis in Wnt-1 transgenic mice by insertional activation of int-2/Fgf-3 and hst/Fgf-4," Proc. Natl. Acad. Sci. USA, 90, 740-744 (1993).

Heikinheimo, M. et al., "Fgf-8 expression in the post-gastrulation mouse suggest roles in the development of the face, limbs and central nervous system," Mech. Dev. 48:129-138 (1994).

Kolodziejczyk, S.M. and Hall, B.K., "Signal transduction and TGF-beta superfamily receptors," Biochem. Cell. Biol., 74:299-314 (1996).

Attisano, L. and Wrana, J.L., "Signal Transduction by Members of the Transforming Growth Factor-beta Superfamily," Cytokine & Growth Factor Rev., 7(4):327-339 (1996).

Hill, C.S., "Signalling to the Nucleus by Members of the Transforming Growth Factors-beta (TGF-beta) Superfamily," Cell. Signal., 8(8):533-544 (1996).

Roberts, A.B. and Sporn, M.B. (1990) "The Transforming Growth Factor-betas," in Peptide Growth Factors and Their Receptors, Sporn and Roberts eds., Berlin: Springer-Verlag, pp. 419-472.

Weeks, D.L. and Melton, D.A., "A Maternal mRNA Localized to the Vegetal Hemisphere in Xenopus Eggs Codes for a Growth Factor Related to TGF-beta," Cell, 51:861-867 (1987).

Padgett, R.W. et al., A transcript from a *Drosophila* pattern gene predicts a protein homologous to the transforming growth factor-beta gamily, Nature, 325:81-84 (1987).

Mason, A.J. et al., "Complementary DNA sequences of ovarian follicular fluid inhibin show precursor structure and homology with transforming growth factor-beta," Nature, 318:659-663 (1985).

Mason, A.J. et al., Activin B: Precursor Sequences, Genomic Structure and in Vitro Activities, Molecular Endocrinology, 3(9):1352-1358 (1989).

Cate, R.L. et al., "Isolation of the Bovine and Human genes for Mülleran Inhibiting Substance and Expression of the Human Gene in Animal Cells," Cell, 45:685-698 (1986).

Wozney, J.M. et al., "Novel Regulators of Bone Formation: Molecular Clones and Activities," Science, 242:1528-1534 (1988).

Lyons, K. et al., "Vgrl, a mammalian gene related to Xenopus Vg-1, is a member of the transforming growth factor beta gene superfamily," Proc. Natl. Acad. Sci. USA, 86:4554-4558 (1989).

Jones, C.M. et al., "Isolation of Vgr-2, a Novel Member of the Transforming Growth Factor-beta-Related Gene Family," Molec. Endocrinol., 6(11):1961-1968 (1992).

Kingsley, D.M., "The TGF-beta superfamily: new members, new receptors, and new genetic tests of function in different organisms," Genes & Dev., 8:133-146 (1994).

McPherron, A.C. and Lee, S., "GDF-3 and GDF-9: Two New Members of the Transforming Growth Factor-beta Superfamily Containing a Novel Pattern of Cysteines," J. Biol. Chem., 268(5):3444-3449 (1993).

Meno, C. et al., "Left-right asymmetric expression of the TGF beta-family member lefty in mouse embryos," Nature, 381:151-155 (1996).

Bouillet, P. et al., "Efficient Cloning of cDNAs of Retinoic Acid-Responsive Genes in P19 Embryonal Carcinoma Cells and Characterization of a Novel Mouse Gene, Stral (Mouse LERK-2/Eplg2)," Dev. Biol., 170:420-433 (1995).

Lin, L.H. et al., GDNF: A Glial Cell Line-Derived Neurotrophic Factor for Midbrain Dopaminergic Neurons, Science, 260:1130-1132 (1993).

Kotzbauer, P.T. et al., Neurturin, a relative of glial-cell-line derived neurotrophic factor, Nature, 384:467-470 (1996).

Kothapalli, R. et al., "Detection of ebaf, a Novel Human Gene of the Transforming Growth Factor Beta Superfamily," J. Clin. Invest., 99(10):2342-2350 (1997).

Gentry, L.E. et al., Type 1 Transforming Growth Factor Beta: Amplified Expression and Secretion of Mature and Precursor Polypeptides in Chinese Hamster Ovary Cells, Mol. Cell. Biol. 7(10):3418-3427 (1987).

De Martin, R. et al., "Complementary DNA for human glioblastoma-derived T cell suppressor factor, a novel member of the transforming growth factor—beta gene family," EMBO J., 6(12):3673-3677 (1987).

Derynck, R. et al., "A new type of transforming growth factor-beta, TGF-beta3," EMBO J., 7(12):3737-3743 (1988).

Dijke, P.T. et al., "Idenitifcation of another member of the transforming growth factor type beta gene family," Proc. Natl. Acad. Sci. USA, 85:4715-4719 (1988).

Marquardt, H. et al., "Complete Amino Acid Sequence of Human Transforming Growth Factor Type beta2," J. Biol. Chem., 262(25):12127-12131 (1987).

Cheifetz, S. et al., "The Transforming Growth Factor-beta System, a Complex Pattern of Cross-Reactive Ligands and Receptors," Cell, 48:409-415.

Jakowlew, S.B. et al., "Complementary Deoxyribonucleic Acid Cloning of a Novel Transforming Growth Factor-beta Messenger Ribonucelic Acid from Chick Embryo Chondrocytes," Molecular Endocrin., 2(8):747-755 (1988).

Derynck, R. et al., "The Murine Transforming Growth Factor-beta Precursor," J. Biol. Chem., 261(10):4377-4379 (1986).

Sharples, K. et al., Cloning and Sequence Analysis of Simian Transforming Growth Factor-beta cDNA, DNA, 6(3):239-244 (1987).

Derynck, R. et al., "Intron-exon structure of the human transforming growth factor-beta precursor gene," Nucl. Acids. Res., 15(7):3188-3189 (1987).

Derynck, R. et al., "Sequence of the porcine transforming growth factor—beta precursor," Nucl. Acids. Res., 15(7):31817 (1987).

Seyedin, S.M. et al., "Cartilage-inducing Factor-A," J. Biol. Chem., 261(13):5693-5695 (1986).

Madisen, L. et al., "Transforming Growth Factor-beta2: cDNA Cloning and Sequence Analysis," DNA, 7(1):1-8 (1988).

(56) References Cited

OTHER PUBLICATIONS

Hanks, S.K. et al., "Amino acid sequence of the BSC-1 cell growth inhibitor (polyergin) deduced from the nucleotide sequence of the Cdna," Proc. Natl. Acad. Sci. USA, 85:79-82 (1988).
Jakowlew, S.B. et al., "Complementary Deoxyribonucleic Acid Cloning of a Messenger Ribonucleic Acid Encoding Transforming Growth Factor beta 4 from Chicken Embryo Chondrocytes," Molec. Endocrinol., 2:1186-1195 (1988).
Wakefield, L.M. et al., "Latent Transforming Growth Factor-beta from Human Platelets," J. Biol. Chem., 263(16):7646-7654 (1988).
Wakefield, L.M. et al., Recombinant TGF-Beta1 Is Synthesized as a Two-Component Latent Complex That Shares Some Structural Features with the Native Platelet Latent TGF-BETA1 Complex, Growth Factors, 1:203-218 (1989).
Gray, A.M. and Mason, A.J., "Requirement for Activin A and Transforming Growth Factor-Beta1 Pro-Regions in Homodimer Assembly," Science, 247:1328-1330 (1990).
Stewart, J.M. and Young, J.D. (1969) "The Chemistry of Solid-Phase Peptide Synthesis," in Solid-Phase Peptide Synthesis, San Francisco, California: W.H. Freeman Co., pp. 1-26.
Merrifield, R.B., "Solid Phase Peptide Synthesis. I. The Synthesis of a Tetrapeptide," J. Am. Chem. Soc., 85:2149-2154 (1963).
Sambrook, J. et al. (1989) "Conditions for Hybridization of Oligonucleotide Probes," in Molecular Cloning: A Laboratory Manual, New York: Cold Spring Harbor Laboratory Press, pp. 11.45-11.61.
Dieffenbach, C.L. and Dveksler, G.S. (1995) "A Standard PCR Protocol: Rapid Isolation of DNA and PCR Assay for Beta-Globin," in PCR Primer: A Laboratory Manual, New York: Cold Spring Harbor Laboratory Press pp. 17-21.
Butler, M. (1991) "The characteristics and growth of cultured cells," in Mammalian Cell Biotechnology: a Practical Approach, M. Butler, ed., New York: Oxford University Press, pp. 1-25.
Graham, F.L. and van der Eb, A.J., "A New Technique for the Assay of Infectivity of Human Adenovirus 5 DNA," Virology, 52:456-457 (1973).
Van Solingen, P. et al., "Fusion of Yeast Spheroplasts," J. Bact., 130 (2) :946-947 (1977).
Hsiao, C.L. and Carbon, J., "High-frequency transformation of yeast by plasmids containing the cloned yeast ARG4 gene," Proc. Natl. Acad. Sci. USA, 76(8):3829-3833 (1979).
Keown, W.A. et al., "Methods for Introducing DNA into Mammalian Cells," Methods in Enzymology, 185:527-537 (1990).
Mansour, S.L. et al., "Disruption of the proto-oncogene int-2 in mouse embryo-derived stem cells: a general strategy for targeting mutations to non-selectable genes," Nature, 336:348-352 (1988).
Beach, D. and Nurse, P., "High-frequency transformation of the fission yeast *Schizosaccharomyces pombe*," Nature, 290:140-142 (1981).
Fleer, R. et al., "Stable Multicopy Vectors for High-Level Secretion of Recombinant Human Serum Albumin by Kluyveromyces Yeasts," Bio/Technology, 9:968-975 (1991).
De Louvencourt, L. et al., "Transformation of Kluyveromyces lactis by Killer Plasmid DNA," J. Bacteriol., 154(2)737-742 (1983).
Van den Berg, J.A. et al., "Kluyveromyces as a Host for Heterologous Gene Expression: Expression and Secretion of Prochymosin," Bio/Technology, 8:135-139 (1990).
Sreekrishna, K. et al., "High level expression of heterologous proteins in methylo-trophic yeast *Pichia pastoris*," J. Basic Microbiol., 28(4):265-278 (1988).
Case, M.E. et al., "Efficient transformation of Neurospara crassa by utilizing hybrid plasmid DNA," Proc. Natl. Acad. Sci. USA, 76(1):5259-5263 (1979).
Balance, D.J. et al., "Transformation of Aspergillus Nidulans by the Orotidine-5' Phosphate Decarboxylase Gene," Biochem. Biophys. Res. Commun., 112(1):284-289 (1983).
Tilburn, J. et al., "Transformation by integration in Aspergillus nidulans," Gene, 26:205-221 (1983).
Yelton, M.M. et al., "Transformation of Aspergillus nidulans by using a trpC plasmid," Proc. Natl. Acad. Sci. USA, 81:1470-1474 (1984).

Kelly, J.M. and Hynes, M.J., "Transformation of Aspergillus niger by the amdS gene of Aspergillus nidulans," EMBO J., 4(2):475-479 (1985).
Anthony, C. (1982) "Metabolism in the methylotrophic yeasts," in The Biochemistry of Methylotrophs, New York: Academic Press, Inc., pp. 269-295.
Graham, F.L. and Smiley, J., "Characteristics of a Human Cell Line Transformed by DNA from Human Adenovirus Type 5," J. Gen Virol., 36:59-72 (1977).
Urlaub, G. and Chasin, L.A., "Isolation of Chinese hamster cell mutants deficient in dihydrofolate," Proc. Natl. Acad. Sci. USA, 77(7):4216-4220 (1980).
Mather, J.P., "Establishment and Characterization of Two Distinct Mouse Testicular Epithelial Cell Lines," Biol. Reprod., 23:243-252 (1980).
Stinchcomb, D.T. et al., "Isolation and characterization of a yeast chromosomal replicator," Nature, 282:39-43 (1979).
Kingsman, A.J. et al., "Replication in *Saccharomyces cerevisiae* of Plasmid pBR313 Carrying DNA from the Yeast trpl Region," Gene, 7:141-152 (1979).
Tschumper, G. and Carbon, J., "Sequence of a yeast DNA fragment containing a chromosomal replicator and the TRP1 gene," Gene, 10:157-166 (1980).
Jones, E.W., "Proteinase Mutants of *Saccharomyces cerevisiae*," Genetics, 85:23-33 (1977).
Chang, A.C.Y., et al., "Phenotypic expression in *E. coli* of a DNA sequence coding for mouse dihydrofolate reductase," Nature, 275:617-624 (1978).
Goeddel, D.V. et al., "Direct expression in *Escherichia coli* of a DNA sequence coding for human growth hormone," Nature, 281:544-548 (1979).
Goeddel, D.V., "Synthesis of human fibroblast interferon by *E. coli*," Nucleic Acids Res., 8(18):4057-4074 (1980).
DeBoer, H.A. et al., "The tac promoter: A functional hybrid derived from the trp and lac promoters," Proc. Natl. Acad. Sci. USA, 80:21-25 (1983).
Hitzeman, R.A. et al., "Isolation and Characterization of the Yeast 3-Phosphoglycerokinase Gene (PGK) by an Immunological Screening Technique," J. Biol. Chem., 255(24):12073-12080 (1980).
Hess, B. et al., "Cooperation of Glycolytic Enzymes," J. Adv. Enzyme Reg., 7:149-167 (1968).
Holland, M.J. and Holland, J.P., Isolation and Identification of Yeast Messenger Ribonucleic Acids Coding for Enolase, Glyceraldehyde-3-phosphate Dehydrogenase, and Phosphoglycerate Kinase, Biochemistry, 17:4900 (1978).
Gething, M.J. and Sambrook, J., "Cell-surface expression of influenza haemagglutinin from a cloned DNA copy of the RNA gene," Nature, 293:620-625 (1981).
Mantei, N. et al., "Rabbit Beta-globin mRNA production in mouse L cells transformed with cloned rabbit Beta-globin chromosomal DNA," Nature, 281:40-46 (1979).
Thomas, P.S., "Hybridization of denatured RNA and small DNA fragments transferred to nitrocellulose," Proc. Natl. Acad. Sci. USA, 77(9):5201-5205 (1980).
Deutscher, M.P., "Maintaining Protein Stability," Methods in Enzymology, 182:83-89 (1990).
Scopes, R.K., "The Protein Purification Laboratory," in Protein Purification: Principles and Practice, Third Edition, New York: Springer-Verlag, pp. 1-17 (1982).
Bolivar, F. et al., "Construction and Characterization of new Cloning Vehicles," Gene, 2:75-93 (1977).
Somparyrac, L.M. et al., "Efficient infection of monkey cells with DNA of simian virus 40," Proc. Natl. Acad. Sci. USA, 78(12):7575-7578 (1981).
Ausubel, F.M. et al., "Construction of Hybrid DNA Molecules," in Current Protocols in Molecular Biology, Unit 3.16.1-3.16.11, New York: John Wiley and Sons, Inc. (1987).
Lucas, B.K. et al., "High-level production of recombinant proteins in CHO cells using a dicistronic DHFR intron expression vector," Nucl. Acids Res. 24(9):1774-1779 (1996).
O'Reilley, D.R. et al., "Cotransfection and recombinant virus identification," in Baculovirus expression vectors: A laboratory Manual, New York: W.H. Freeman and Company, pp. 139-179 (1992).

(56) References Cited

OTHER PUBLICATIONS

Rupert, S. et al., "Cloning and expression of human TAF11250: a TBP-associated factor implicated in cell-cycle regulation," Nature, 362:175-179 (1993).
Perler, F.B. et al., "Protein splicing elements: inteins and exteins—a definition of terms and recommended nomenclature," Nucleic Acids Res. 22(7):1125-1127 (1994).
Perler, F.B. et al., "Protein splicing and autoproteolysis mechanisms," Curr. Opin. Chem. Biol. 1:292-299 (1997).
Perler, F. B., "Protein Splicing of Inteins and Hedgehog Autoproteolysis: Structure Function, and Evolution," Cell 92:1-4 (1998).
Xu, M.Q. and Perler, F.B., "The mechanism of protein splicing and its modulation by mutation," EMBO J. 15(19):5146-5153 (1996).
Chong, S. et al., "Single-column purification of free recombinant proteins using a self-cleavable affinity tag derived from a protein splicing element," Gene 192:271-281 (1997).
Evans, T.C. et al., "Semisynthesis of cytotoxic proteins using a modified protein splicing element," Protein Sci. 7:2256-2264 (1998).
Muir, T.W. et al., "Expressed protein ligation: A general method for protein engineering," Proc. Natl. Acad. Sci. USA, 95:6705-6710 (1998).
Fleischman, J.B. et al., "The Arrangement of the Peptide Chains in γ-Globulin," Biochem J. 88:220-228 (1963).
Edelman, G.M. et al. "The Covalent Structure of an Entire γG Immunoglobulin Molecule," Biochemistry, 63:78-85 (1969).
Reddy, V.B. et al., "The Genome of Simian Virus 40," Science 200:494-502 (1978).
Southern, P.J. and Berg, P., "Transformation of Mammalian Cells to Antibiotic resistance with a Bacterial Gene Under Control of the SV40 Early Region Promoter," J. Mol. Appl. Gen., 1:327-341 (1982).
Kozak, M., "Structural Features in Eukaryotic mRNAs That Modulate the Initiation of Translation," J. Biol. Chem, 266(30):19867-19870.
Mulligan, R.C. and Berg, P., "Expression of a Bacterial Gene in Mammalian Cells," Science, 209:1422-1427 (1980).
Sugden, B. et al., "A Vector That Replicates as a Plasmid and can Be Efficiently Selected in B-Lymphoblasts Transformed by Epstein-Barr Virus," Mol. Cell. Biol. 5(2):410-413 (1985).
Ellison, J.W. et al., "The nucleotide sequence of a human immunoglobulin Cγ1 gene," Nuc. Acids Res. 10(13): 4071-4079 (1982).
Thimmappaya, B. et al., "Adenovirus VAI RNA Is required for Efficient Translation of Viral mRNAs at Late Times after Infection," Cell, 31:543-551 (1982).
Gorman, C.M. et al., "Transient Production of Proteins Using an Adenovirus Transformed Cell Line," DNA Prot. Eng. Tech., 2(1):3-10 (1990).
Chisholm, V. (1995) "High Efficiency Gene Transfer into Mammalian Cells," in DNA Cloning 4. Mammalian Systems, Glover, D.M, Hames, B.D. eds., New York: Oxford University Press, pp. 1-41.
Zinoni, F. et al., "Nucleotide sequence and expression of the selenocysteine-containing polypeptide of formate dehydrogenase (formate-hydrogen-lyase-linked) from *Escherichia coli*", Proc. Natl Acad. Sci. USA, 83:4650-4654 (1986).
Chambers, I. et al., "The structure of the mouse glutathione peroxidase gene: the selenocysteine in the active site is encoded by the 'termination' codon, TGA," EMBO J., 5(6):1221-1227 (1986).
Schnolzer, M. et al. "In situ neutralization in Boc-chemistry solid phase peptide synthesis: Rapid, high yield assembly of difficult sequences," Int. J. Pept. Protein Res., 40:180-193 (1992).
Sarin, V.K. et al., "Quantitative Monitoring of Solid-Phase Peptide Synthesis by the Ninhydrin Reaction," Anal. Biochem. 117, 147-157 (1981).
Hackeng, T.M. et al., "Protein synthesis by native chemical ligation: Expanded scope by using straightforward methodology," Proc. Natl. Acad. Sci. USA, 96:10068-10073 (1999).
Evans, T.C. et al., "The in Vitro Ligation of Bacterially Expressed Proteins Using an Intein from Methanobacterium thermoautotrophicum," J. Biol. Chem. 274(7):3923-3926 (1999).

Tyler, B.M. et al., "mRNA for surface immunoglobulin γ chains encodes a highly conserved transmembrane sequence and a 28-residue intracellular domain," Proc. Natl. Acad. Sci. USA, 79:2008-2012 (1982).
Yamawaki-Kataoka, Y. et al., "Nucleotide sequences of gene segments encoding membrane domains of immunoglobulin γ chains," Proc. Natl. Acad. Sci. USA, 79:2623-2627 (1982).
Strausberg, R.L. et. al., "Generation and initial analysis of more than 15,000 full-length human and mouse cDNA sequences," Proc. Natl. Acad. Sci. USA, 99(26):16899-16903 (2002).
Perler, F.B., "InBase: the Intein Database," Nucl. Acids Res. 30(1):383-384 (2002).
Fleischman, J.B. et al., "Reduction of γ-Globulins," Arch. Biochem. Biophys. (Suppl.) 1:174-180 (1962).
Edelman, G.M. et al., "Reconstitution of Immunologic Activity by Interaction of Polypeptide Chains of Antibodies," Biochemistry, 50:753-761 (1963).
Haber, E. and Anfinsen, C.B., "Regeneration of Enzyme Acitivity by Air Oxidation of Reduced Subtilisin-Modified Ribonuclease," J. Biol. Chem. 236(2):422-424 (1961).
Smith, D.H. et al., "Blocking of HIV-1 Infectivity by a Soluble, Secreted Form of the CD4 Antigen," Science, 238:1704-1707 (1987).
Lasky, L.A. et al., "Delineation of a Region of the Human Immunodeficiency Virus Type 1 gp120 Glycoprotein Critical for Interaction with the CD4 Receptor," Cell 50, 975-985 (1987).
Robert-Guroff, M. et al., "HTLB-III-neutralizing antibodies in patients with AIDS and AIDS-related complex," Nature, 316:72-74 (1985).
Gallo, R.C. et al., "Frequent Detection and Isolation of Cytopathic Retroviruses (HTLB-III) from Patients with AIDS and at Risk for AIDS," Science 224:500-503 (1984).
Groopman, J.E. et al., "Characterization of Serum Neutralization Response to the Human Immunodeficiency Virus (HIV)," AIDS Res. Hum. Retroviruses, 3(1):71-85 (1987).
Poiesz, B.J. et al., "Detection and isolation of type C retrovirus particles from fresh and cultured lymphocytes of a pateint with cutaneous T-cell lymphoma," Proc. Acad. Nat. Sci. USA, 77(12):7415-7419 (1980).
Ashkenazi, A. et al., "Protection against endotoxic shock by a tumor necrosis fator receptor immunoadhesin," Proc. Natl. Acad. Sci. USA, 88:10535-10539 (1991).
Kawade, Y. and Watanabe, Y., "Neutralization of Interferon by Antibody: Appraisals of Methods of Determining and Expressing the Neutralization Titer," J. Interferon Res., 4:571-584 (1984).
Park, J.E. et al., "Placenta Growth Factor," J. Biol. Chem., 269(41):25646-25654 .
Keyt, B.A. et al., "Identification of Vascular Endothelial Growth factor determinants for Binding KDR and FLT-1 Receptors," J. Biol Chem., 271:5638-5646 (1996).
Leung, D.W. et al., "Vascular Endothelial Growth Factor Is a Secreted Angiogenic Mitogen," Science, 246:1306-1309 (1989).
Kim, K.J. et al., "Inhibition of vascular endothelial growth factor-induced angiogenesis suppresses tumour growth in vivo," Nature 362:841-844 (1993).
Borgstrom, P. et al., "Complete Inhibition of Angiogenesis and Growth of Microtumors by Anti-Vascular Endothelial Growth Factor Neutralizing Antibody: Novel Concepts of Angiostatic Therapy from Intravital Videomicroscopy," Cancer Res., 56:4032-4039 (1996).
Sliwkowski, M.X. et al., "Coexpression of erbB2 and erbB3 proteins Reconstitutes a High Affinity Receptor for Heregulin," J. Biol. Chem., 269(20):14661-14665 (1994).
Munson, P.J. and Robard, D., "Ligand: A Versatile Computerized Approach for Characterization of Ligand-Binding Systems," Analytical Biochemistry, 107:220-239 (1980).
Lewis, G.D. et al., "Growth Regulation of Human Breast and Ovarian Tumor Cells by Heregulin: Evidence for the Requirement of ErbB2 as a Critical Component in Mediating Heregulin Responsivenes," Cancer Res., 56:1457-1465 (1996).
Hodgson, J., "Data-Directed Drug Design," Bio/Technology, 9:19-21 (1991).

(56) References Cited

OTHER PUBLICATIONS

Braxton, S. and Wells, J.A., "Incorporation of a Tabilizing Ca2+-Binding Loop into Subtilisin BPN'" Biochemistry, 31:7796-7801 (1992).
Athauda, S.B.P. et al., "Entrapment and Inhibition of Human Immunodeficiency Virus Proteinase by alpha2-Macroglobulin and Structural Changhes in the Inhibitor," J. Biochem., 113:742-746 (1993).
Kruisbeek, A.M. et al. (2004) "Proliferative Assays for T Cell Function," in Current Protocols in Immunology, unit 3.12; Coligan, J.E. et al. eds., New York: John Wiley & Sons, Inc. 3.12.1-3.12.20.
Skehan, P. et al., "New Colorimetric Cytotoxicity Assay for Anticancer-Drug Screening," J. Natl. Cancer Inst., 82(13):1107-1112 (1990).
Monks, A. et al., "Feasibility of a High-Flux Anticancer Drug Screen Using a Diverse Panel of Cultured Human Tumor Cell Lines," J. Natl. Cancer Inst., 83(11):757-766 (1991).
Boyd, M.R. "CTEP Handbook Appendices," Princ. Pract. Oncol., 3(10):1-12 (1989).
International Search Report dated May 13, 2009 in connection with PCT International Application No. PCT/US07/023298.
Written Opinion dated May 13, 2009 in connection with PCT International Application No. PCT/US07/023298.
International Preliminary Report on Patentability dated Jul. 28, 2009 in connection with PCT International Application No. PCT/US07/023298.
Extended European Search Report, including European Search Opinion, dated Jul. 12, 2010 issued in connection with related European Application No 07874106.3.
Zigmund et al., Expression and Purification of N-Methyltransferases in *Escherichia Coli*, protein Expression and Purification, 28(2):280-286 (2003).
Wojtaszek et al., LTCI, A Novel Chymotrypsin Inhibitor of the Potato I Family from the Earthworm *Lumbricus terrestris*. Purification, cDNA Cloning and Expression, Comparative Biochemistry and Physiology. Part B, Biochemistry and Molecular Biology, 143(4):465-472 (2006).
Feb. 8, 2011 Response filed in connection with European Patent Application No. 07874106.3.
Nov. 28, 2012 Communication from the Examining Division, issued in connection with European Patent Application No. 07874106.3.
English Language Translation of Jul. 7, 2011 Office Action issued in connection with Israeli Patent Application No. 198424.
English Language Translation of May 6, 2012 Response filed in connection with Israeli Patent Application No. 198424.
Mar. 5, 2013 Notification of Technical Defects Prior to Acceptance, issued in connection with Israeli Patent Application No. 198424.
English Language Translation of Feb. 21, 2013 Office Action issued in connection with Japanese Patent Application No. 2009-535349.
Jul. 4, 2012 Office Action issued in connection with Chinese Patent Application No. 200780041028.8, including English Language Translation.
Jan. 21, 2013 Response filed in connection with Chinese Patent Application No. 200780041028.8.
Oct. 26, 2012 Response filed in connection with Australian Patent Application No. 2007353396.
Nov. 19, 2012 Supplemental Response filed in connection with Australian Patent Application No. 2007353396.
Jan. 7, 2013 Notice of Acceptance issued in connection with Australian Patent Application No. 2007353396.
Jan. 7, 2013 Notice Regarding Error in Number of Claims issued in connection with Australian Patent Application No. 2007353396.
Jan. 24, 2013 Post-Acceptance Amendment filed in connection with Australian Patent Application No. 2007353396.
Jan. 16, 2013 Response filed in connection with New Zealand Patent Application No. 576445.
Feb. 8, 2012 Examination Report issued in connection with New Zealand Patent Application No. 576445.
Feb. 18, 2012 Response filed in connection with New Zealand Patent Application No. 576445.
Mar. 8, 2012 Notice of Acceptance issued in connection with New Zealand Patent Application No. 576445.
Mar. 14, 2012 Office Action issued in connection with Mexican Patent Application No. MX/a/2009/004664.
May 21, 2012 Response filed in connection with Mexican Patent Application No. MX/a/2009/004664.
Sep. 11, 2012 Office Action issued in connection with Mexican Patent Application No. MX/a/2009/004664.
Dec. 14, 2012 Response filed in connection with Mexican Patent Application No. MX/a/2009/004664.
Jan. 24, 2013 Supplemental Response filed in connection with Mexican Patent Application No. MX/a/2009/004664.
Chong et al. (1997) "Single-column purification of free recombinant proteins using a self-cleavable affinity tag derived from a protein splicing element." Gene 192:271-281.
Hondal et al. (2001) "Selenocysteine in Native Chemical Ligation and Expressed Protein Ligation." J. Am. Chem. Soc. 123:5140-5141.
Klingenberg and Appel (1989) "The uncoupling protein dimer can form a disulfide cross-link between the mobile C-terminal SH groups." Eur. J. Biochem. 180: 123-131.
Muir (2003) "Semisynthesis of Proteins by Expressed Protein Ligation" Annu. Rev. Biochem. 72:249-289.
Jul. 11, 2013 Office Action, issued in connection with Japanese Patent Application No. 2009-535349.
Jul. 4, 2013 Response, including English Language Translation, filed in connection with Israeli Patent Application No. 198424.
May 21, 2013 Office Action, including English Language Translation, issued in connection with Chinese Patent Application No. 200780041028.8.
Jul. 11, 2013 Office Action issued in connection with Japanese Patent Application No. 2009-535349, including English Language Translation thereof.
Jul. 4, 2013 Response filed in connection with Israeli Patent Application No. 198424, including English Language Translation thereof.
May 21, 2013 Office Action issued in connection with Chinese Patent Application No. 200780041028.8, including English Language Translation thereof.
Sep. 30, 2013 Response filed in connection with Chinese Patent Application No. 200780041028.8, including English Language Translation of the response Cover Page.
Dec. 13, 2013 Office Action issued in connection with Chinese Patent Application No. 200780041028.8, including English Language Translation of the Cover Page.
Nov. 11, 2013 Notice of Appeal, filed in connection with Japanese Patent Application No. 2009-535349.
Dec. 5, 2013 Appeal Brief, filed in connection with Japanese Patent Application No. 2009-535349.
English Language Translation of the Dec. 13, 2013 Office Action that issued in connection with Chinese Patent Application. No. 200780041028.8.
Feb. 7, 2014 Office Action, issued in connection with Japanese Patent Application No. 2009-535349, and English Language Translation thereof.
Feb. 20, 2014 Response, filed in connection with Japanese Patent Application No. 2009-535349, including English Language claims.
Mar. 10, 2014 Notice of Allowance, issued in connection with Japanese Patent Application No. 2009-535349.
Dec. 10, 2013 Request for Examination and Voluntary Amendment, filed in connection with Japanese Patent Application No. 2013-232946.
Dec. 18, 2013 Office Action, issued in connection with Canadian Patent Application No. 2,668,208.
Shen et al., (2005) Single-Chain Fragment Variable Antibody Piezoimmunosensors. Anal. Chem., 77, 797-805.
Jun. 17, 2014 Response, filed in connection with Canadian Patent Application No. 2,668,208.
May 26, 2014 Notice of Preliminary Rejection, issued in connection with Korean Patent Application No. 2009-7011296).

(56) References Cited

OTHER PUBLICATIONS

Bond-Breaker TCEP Solution, Neutral pH, Thermo Scientific Pierce Protein Biology Products, available from www.piercenet.com/product/bond-breaker-tcep-solution-neutral-ph (accessed Aug. 22, 2014).

English language translation of the Particulars and the Claims of Japanese Patent No. 5519287, dated Apr. 11, 2014 (Daniel J. Capon).

Oct. 8, 2014 Communication, issued in connection with European Patent Application No. 07874106.3.

Jul. 27, 2014 Response, filed in connection with Israeli Patent Application No. 198424, including English language translation.

Oct. 24, 2014 Response, filed in connection with Korean Patent Application No. 2009-7011296.

Dakappagari et al (Journal of Biological Chemistry, 2005, 280:54-63).

Hondal et el (Semisynthesis of Proteins Containing Selenocysteine, Methods in Enzymology, 2002 vol. 347, p. 70-83).

Wright et al (Effect of Glycosylation on Antibody Function: Implications for Genetic Engineering, Trends in Biotech, 1997, vol. 15, p. 26-32).

Hitzeman et al (Use of Heterologous and Homologous Signal Sequences for Secretion of Heterologous Protein from Yeast, Meth Enzymology, 1990, vol. 185, p. 421-441).

* cited by examiner (i) 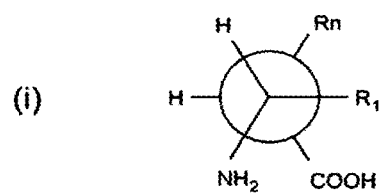
(ii) 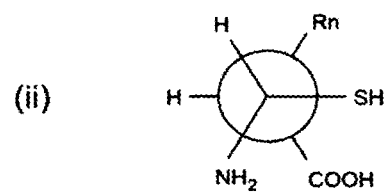
(iii) 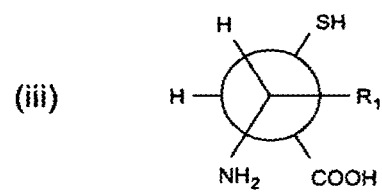
(iv) 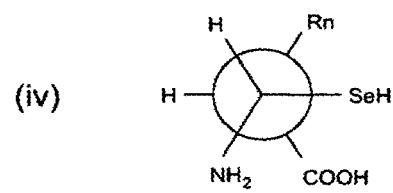
(v) 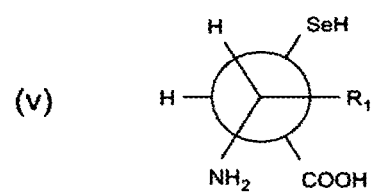
FIG. 1

(i) 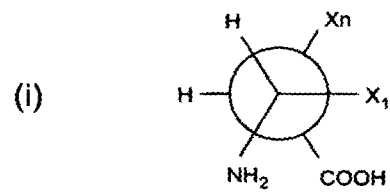
(ii) 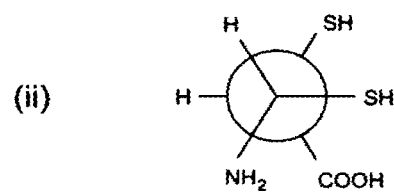
(iii) 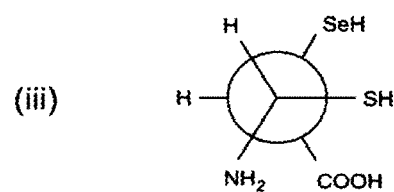
(iv) 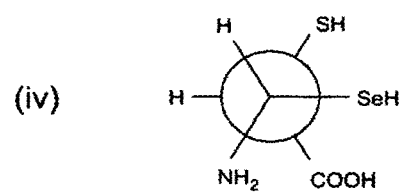
(v) 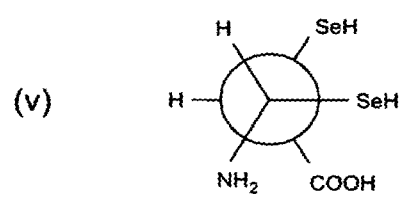
FIG. 2

IgG1 Fc N-terminal-S-terminus (i) PRE-Fc

```
SHH    MLLLARCLLLVLVSSLLVCSGLA                                    -23
IFN    MALTFALLVALLVLSCKSSCSVG                                    -23
CETP   MLAATVLTLALLGNAHA                                          -17

CDKTHTCPPCPAPELLGGPSVFLFPPKPKDTLMISRTPEVTCVVVDVSHEDPEVKFNWYV       60
DGVEVHNAKTKPREEQYNSTYRVVSVLTVLHQDWLNGKEYKCKVSNKALPAPIEKTISKA      120
KGQPREPQVYTLPPSRDELTKNQVSLTCLVKGFYPSDIAVEWESNGQPENNYKTTPPVLD      180
SDGSFFLYSKLTVDKSRWQQGNVFSCSVMHEALHNHYTQKSLSLSPGK                  228
```

(ii) S-Fc

```
CDKTHTCPPCPAPELLGGPSVFLFPPKPKDTLMISRTPEVTCVVVDVSHEDPEVKFNWYV       60
DGVEVHNAKTKPREEQYNSTYRVVSVLTVLHQDWLNGKEYKCKVSNKALPAPIEKTISKA      120
KGQPREPQVYTLPPSRDELTKNQVSLTCLVKGFYPSDIAVEWESNGQPENNYKTTPPVLD      180
SDGSFFLYSKLTVDKSRWQQGNVFSCSVMHEALHNHYTQKSLSLSPGK                  228
```

FIG. 35A

IgG2 Fc N-terminal-S-terminus (i) PRE-Fc

```
SHH                                                         MLLLARCLLLVLVSSLLVCSGLA      -23
IFN                                                         MALTFALLVALLVLSCKSSCSVG      -23
CETP                                                             MLAATVLTLALLGNAHA       -17

CCVECPPCPAPPVAGPSVFLFPPKPKDTLMISRTPEVTCVVVDVSHEDPEVQFNWYVDGV                              60
EVHNAKTKPREEQFNSTFRVVSVLTVVHQDWLNGKEYKCKVSNKGLPAPIEKTISKTKGQ                             120
PREPQVYTLPPSREEMTKNQVSLTCLVKGFYPSDIAVEWESNGQPENNYKTTPPMLDSDG                             180
SFFLYSKLTVDKSRWQQGNVFSCSVMHEALHNHYTQKSLSLSPGK                                            225
```

(ii) S-Fc

```
CCVECPPCPAPPVAGPSVFLFPPKPKDTLMISRTPEVTCVVVDVSHEDPEVQFNWYVDGV                              60
EVHNAKTKPREEQFNSTFRVVSVLTVVHQDWLNGKEYKCKVSNKGLPAPIEKTISKTKGQ                             120
PREPQVYTLPPSREEMTKNQVSLTCLVKGFYPSDIAVEWESNGQPENNYKTTPPMLDSDG                             180
SFFLYSKLTVDKSRWQQGNVFSCSVMHEALHNHYTQKSLSLSPGK                                            225
```

FIG. 35B

IgG3 Fc N-terminal-S-terminus (i) PRE-FC

```
SHH       MLLLARCLLLLVLVSSLLVCSGLA              -23
IFN       MALTFALLVALLVLSCKSSCSVG               -23
CETP              MLAATVLTLALLGNAHA             -17

CPRCPEPKSCDTPPPCPRCPEPKSCDTPPPCPRCPAPELLGGPSV    60
FLFPPKPKDTLMISRTPEVTCVVVDVSHEDPEVQFKWYVDGVEVHNAKTKPREEQFNSTF  120
RVVSVLTVLHQDWLNGKEYKCKVSNKALPAPIEKTISKTKGQPREPQVYTLPPSREEMTK  180
NQVSLTCLVKGFYPSDIAVEWESSGQPENNYNTTPPMLDSDGSFFLYSKLTVDKSRWQQG  240
NIFSCSVMHEALHNRFTQKSLSLSPGK                                    267
```

(ii) S-FC

```
CPRCPEPKSCDTPPPCPRCPEPKSCDTPPPCPRCPAPELLGGPSV    60
FLFPPKPKDTLMISRTPEVTCVVVDVSHEDPEVQFKWYVDGVEVHNAKTKPREEQFNSTF  120
RVVSVLTVLHQDWLNGKEYKCKVSNKALPAPIEKTISKTKGQPREPQVYTLPPSREEMTK  180
NQVSLTCLVKGFYPSDIAVEWESSGQPENNYNTTPPMLDSDGSFFLYSKLTVDKSRWQQG  240
NIFSCSVMHEALHNRFTQKSLSLSPGK                                    267
```

FIG. 35C

IgG4 Fc N-terminal-S-terminus (i) PRE-Fc

```
SHH       MLLLARCLLLVLVSSLLVCSGLA                -23
IFN       MALTFALLVALLVLSCKSSCSVG                -23
CETP             MLAATVLTLALLGNAHA              -17

CPSCPAPEFLGGPSVFLFPPKPKDTLMISRTPEVTCVVVDVSQEDPEVQFNWYVDGVEVH      60
NAKTKPREEQFNSTYRVVSVLTVLHQDWLNGKEYKCKVSNKGLPSSIEKTISKAKGQPRE     120
PQVYTLPPSQEEMTKNQVSLTCLVKGFYPSDIAVEWESNGQPENNYKTTPPVLDSDGSFF     180
LYSRLTVDKSRWQEGNVFSCSVMHEALHNHYTQKSLSLSLGK                        222
```

(ii) S-Fc

```
CPSCPAPEFLGGPSVFLFPPKPKDTLMISRTPEVTCVVVDVSQEDPEVQFNWYVDGVEVH      60
NAKTKPREEQFNSTYRVVSVLTVLHQDWLNGKEYKCKVSNKGLPSSIEKTISKAKGQPRE     120
PQVYTLPPSQEEMTKNQVSLTCLVKGFYPSDIAVEWESNGQPENNYKTTPPVLDSDGSFF     180
LYSRLTVDKSRWQEGNVFSCSVMHEALHNHYTQKSLSLSLGK                        222
```

FIG. 35D

Fc N-terminal-X-terminus (i) PRE-Fc

```
                                    MLLLARCLLLVLVSSLLVCSGLA          -23
SHH                                 MALTFALLVALLVLSCKSSSCSVG         -23
IFNA                                        MLAATVLTLALLGNAHA        -17
CETP

CPPCPAPELLGGPSVFLFPPKPKDTLMISRTPEVTCVVVDVSHEDPEVKFNWYVDGVEVH          60
NAKTKPREEQYNSTYRVVSVLTVLHQDWLNGKEYKCKVSNKALPAPIEKTISKAKGQPRE         120
PQVYTLPPSRDELTKNQVSLTCLVKGFYPSDIAVEWESNGQPENNYKTTPPVLDSDGSFF         180
LYSKLTVDKSRWQQGNVFSCSVMHEALHNHYTQKSLSLSPGK                          222
```

(ii) S-Fc

```
CPPCPAPELLGGPSVFLFPPKPKDTLMISRTPEVTCVVVDVSHEDPEVKFNWYVDGVEVH          60
NAKTKPREEQYNSTYRVVSVLTVLHQDWLNGKEYKCKVSNKALPAPIEKTISKAKGQPRE         120
PQVYTLPPSRDELTKNQVSLTCLVKGFYPSDIAVEWESNGQPENNYKTTPPVLDSDGSFF         180
LYSKLTVDKSRWQQGNVFSCSVMHEALHNHYTQKSLSLSPGK                          222
```

(iii) X-Fc

```
XDKTHTCPPCPAPELLGGPSVFLFPPKPKDTLMISRTPEVTCVVVDVSHEDPEVKFNWYV          60
DGVEVHNAKTKPREEQYNSTYRVVSVLTVLHQDWLNGKEYKCKVSNKALPAPIEKTISKA         120
KGQPREPQVYTLPPSRDELTKNQVSLTCLVKGFYPSDIAVEWESNGQPENNYKTTPPVLD         180
SDGSFFLYSKLTVDKSRWQQGNVFSCSVMHEALHNHYTQKSLSLSPGK                    228
```

FIG. 36A

Fc N-terminal-X-terminus (i) PRE-Fc

```
SHH                                              MLLLARCLLLVLVSSLLVCSGLA      -23
IFNA                                             MALTFALLVALLVLSCKSSCSVG      -23
CETP                                                   MLAATVLTLALLGNAHA      -17

CPAPELLGGPSVFLFPPKPKDTLMISRTPEVTCVVVDVSHEDPEVKFNWYVDGVEVHNAK                   60
TKPREEQYNSTYRVVSVLTVLHQDWLNGKEYKCKVSNKALPAPIEKTISKAKGQPREPQV                  120
YTLPPSRDELTKNQVSLTCLVKGFYPSDIAVEWESNGQPENNYKTTPPVLDSDGSFFLYS                  180
KLTVDKSRWQQGNVFSCSVMHEALHNHYTQKSLSLSPGK                                       219
```

(ii) S-Fc

```
CPAPELLGGPSVFLFPPKPKDTLMISRTPEVTCVVVDVSHEDPEVKFNWYVDGVEVHNAK                   60
TKPREEQYNSTYRVVSVLTVLHQDWLNGKEYKCKVSNKALPAPIEKTISKAKGQPREPQV                  120
YTLPPSRDELTKNQVSLTCLVKGFYPSDIAVEWESNGQPENNYKTTPPVLDSDGSFFLYS                  180
KLTVDKSRWQQGNVFSCSVMHEALHNHYTQKSLSLSPGK                                       219
```

(iii) X-Fc

```
XPPCPAPELLGGPSVFLFPPKPKDTLMISRTPEVTCVVVDVSHEDPEVKFNWYVDGVEVH                   60
NAKTKPREEQYNSTYRVVSVLTVLHQDWLNGKEYKCKVSNKALPAPIEKTISKAKGQPRE                  120
PQVYTLPPSRDELTKNQVSLTCLVKGFYPSDIAVEWESNGQPENNYKTTPPVLDSDGSFF                  180
LYSKLTVDKSRWQQGNVFSCSVMHEALHNHYTQKSLSLSPGK                                    222
```

FIG. 36B

Fc C-terminal-X-terminus (i) PRE-FC-AUTOCLEAVAGE
```
CD2                                                                MSFPCKFVASFLLLIFNVSSKGAVS   -24
CD4                                                 MNRGVPFRHLLLVLQLALLPAATQG                  -25
KTHTCPPCPAPELLGGPSVFLFPPKPKDTLMISRTPEVTCVVVDVSHEDPEVKFNWYVDG                                    60
VEVHNAKTKPREEQYNSTYRVVSVLTVLHQDWLNGKEYKCKVSNKALPAPIEKTISKAKG                                   120
QPREPQVYTLPPSRDELTKNQVSLTCLVKGFYPSDIAVEWESNGQPENNYKTTPPVLDSD                                   180
GSFFLYSKLTVDKSRWQQGNVFSCSVMHEALHNHYTQKSLSLSPELQLEESCAEAQDGEL                                   240
DGCVSGDTIVMTSGGPRTVAELEGKPFTALIRGSGYPCPSGFFRTCERDVVDLRTREGHC                                   300
LRLTHDHRVLVMDGGLEWRAAGELERGDRLVMDDAAGEFPALATFRGLRGAGRQDVYDAT                                   360
VYGASAFTANGFIVHACGEQPGTGLNSGLTTNPGVSAWQVNTAYTAGQLVTYNGKTYKCL                                   420
QPHTSLAGWEPSNVPALWQLQ                                                                         441
```

(ii) Fc-AUTOCLEAVAGE
```
KTHTCPPCPAPELLGGPSVFLFPPKPKDTLMISRTPEVTCVVVDVSHEDPEVKFNWYVDG                                    60
VEVHNAKTKPREEQYNSTYRVVSVLTVLHQDWLNGKEYKCKVSNKALPAPIEKTISKAKG                                   120
QPREPQVYTLPPSRDELTKNQVSLTCLVKGFYPSDIAVEWESNGQPENNYKTTPPVLDSD                                   180
GSFFLYSKLTVDKSRWQQGNVFSCSVMHEALHNHYTQKSLSLSPELQLEESCAEAQDGEL                                   240
DGCVSGDTIVMTSGGPRTVAELEGKPFTALIRGSGYPCPSGFFRTCERDVVDLRTREGHC                                   300
LRLTHDHRVLVMDGGLEWRAAGELERGDRLVMDDAAGEFPALATFRGLRGAGRQDVYDAT                                   360
VYGASAFTANGFIVHACGEQPGTGLNSGLTTNPGVSAWQVNTAYTAGQLVTYNGKTYKCL                                   420
QPHTSLAGWEPSNVPALWQLQ                                                                         441
```

(iii) FC-THIOESTER
```
KTHTCPPCPAPELLGGPSVFLFPPKPKDTLMISRTPEVTCVVVDVSHEDPEVKFNWYVDG                                    60
VEVHNAKTKPREEQYNSTYRVVSVLTVLHQDWLNGKEYKCKVSNKALPAPIEKTISKAKG                                   120
QPREPQVYTLPPSRDELTKNQVSLTCLVKGFYPSDIAVEWESNGQPENNYKTTPPVLDSD                                   180
GSFFLYSKLTVDKSRWQQGNVFSCSVMHEALHNHYTQKSLSPELQLEESCAEAQDGEL                                    240
DX                                                                                            242
```

(iv) FC-X
```
KTHTCPPCPAPELLGGPSVFLFPPKPKDTLMISRTPEVTCVVVDVSHEDPEVKFNWYVDG                                    60
VEVHNAKTKPREEQYNSTYRVVSVLTVLHQDWLNGKEYKCKVSNKALPAPIEKTISKAKG                                   120
QPREPQVYTLPPSRDELTKNQVSLTCLVKGFYPSDIAVEWESNGQPENNYKTTPPVLDSD                                   180
GSFFLYSKLTVDKSRWQQGNVFSCSVMHEALHNHYTQKSLSPELQLEESCAEAQDGEL                                    240
DGX                                                                                           243
```

FIG. 37A

Fc C-terminal-s-terminus (i) PRE-Fc

| | | |
|---|---|---|
| CD2 | MSFPCKFVASFLLIFNVSSKGAVS | -24 |
| CD4 | MNRGVPFRHLLLVLQLALLPAATQG | -25 |

KTHTCPPCPAPELLGGPSVFLFPPKPKDTLMISRTPEVTCVVVDVSHEDPEVKFNWYVDG    60
VEVHNAKTKPREEQYNSTYRVVSVLTVLHQDWLNGKEYKCKVSNKALPAPIEKTISKAKG    120
QPREPQVYTLPPSRDELTKNQVSLTCLVKGFYPSDIAVEWESNGQPENNYKTTPPVLDSD    180
GSFFLYSKLTVDKSRWQQGNVFSCSVMHEALHNHYTQKSLSLSPELQLEESC           232

(ii) FC-S

KTHTCPPCPAPELLGGPSVFLFPPKPKDTLMISRTPEVTCVVVDVSHEDPEVKFNWYVDG    60
VEVHNAKTKPREEQYNSTYRVVSVLTVLHQDWLNGKEYKCKVSNKALPAPIEKTISKAKG    120
QPREPQVYTLPPSRDELTKNQVSLTCLVKGFYPSDIAVEWESNGQPENNYKTTPPVLDSD    180
GSFFLYSKLTVDKSRWQQGNVFSCSVMHEALHNHYTQKSLSLSPELQLEESC           232

FIG. 37B

Fc N-terminal-S-terminus AND C-terminal-X-terminus (i) PRE-FC-AUTOCLEAVAGE

```
SHH        MLLLARCLLLLVLVSSLLVCSGLA                                        -23
IFN        MALTFALLVALLVLSCKSSCSVG                                         -23
CETP              MLAATVLTLALLGNAHA                                        -17

CDKTHTCPPCPAPELLGGPSVFLFPPKPKDTLMISRTPEVTCVVVDVSHEDPEVKFNWYV               60
DGVEVHNAKTKPREEQYNSTYRVVSVLTVLHQDWLNGKEYKCKVSNKALPAPIEKTISKA              120
KGQPREPQVYTLPPSRDELTKNQVSLTCLVKGFYPSDIAVEWESNGQPENNYKTTPPVLD              180
SDGSFFLYSKLTVDKSRWQQGNVFSCSVMHEALHNHYTQKSLSLSPELQLEESCAEAQDG              240
ELDGCVSGDTIVMTSGGPRTVAELEGKPFTALIRGSSYPCPSGFFRTCERDVYDLRTREG              300
HCLRLTHDHRVLVMDGGLEWRAAGELERGDRLVMDDAAGEFPALATFRGLRGAGRQDVYD              360
ATVYGASAFTANGFIVHACGEQPTGLNSGLTTNPGVSAWQVNTAYTAGQLVTYNGKTYK               420
CLQPHTSLAGWEPSNVPALWQLQ                                                   443
```

(ii) S-FC-AUTOCLEAVAGE

```
CDKTHTCPPCPAPELLGGPSVFLFPPKPKDTLMISRTPEVTCVVVDVSHEDPEVKFNWYV               60
DGVEVHNAKTKPREEQYNSTYRVVSVLTVLHQDWLNGKEYKCKVSNKALPAPIEKTISKA              120
KGQPREPQVYTLPPSRDELTKNQVSLTCLVKGFYPSDIAVEWESNGQPENNYKTTPPVLD              180
SDGSFFLYSKLTVDKSRWQQGNVFSCSVMHEALHNHYTQKSLSLSPELQLEESCAEAQDG              240
ELDGCVSGDTIVMTSGGPRTVAELEGKPFTALIRGSSYPCPSGFFRTCERDVYDLRTREG              300
HCLRLTHDHRVLVMDGGLEWRAAGELERGDRLVMDDAAGEFPALATFRGLRGAGRQDVYD              360
ATVYGASAFTANGFIVHACGEQPTGLNSGLTTNPGVSAWQVNTAYTAGQLVTYNGKTYK               420
CLQPHTSLAGWEPSNVPALWQLQ                                                   443
```

FIG. 38A

Fc N-terminal-S-terminus AND C-terminal-X-terminus (cont'd)

(iii) S-FC-THIOESTER

<u>C</u>DKTHTCPPCPAPELLGGPSVFLFPPKPKDTLMISRTPEVTCVVVDVSHEDPEVKFNWYV 60
DGVEVHNAKTKPREEQYNSTYRVVSVLTVLHQDWLNGKEYKCKVSNKALPAPIEKTISKA 120
KGQPREPQVYTLPPSRDELTKNQVSLTCLVKGFYPSDIAVEWESNGQPENNYKTTPPVLD 180
SDGSFFLYSKLTVDKSRWQQGNVFSCSVMHEALHNHYTQKSLSLSPELQLEESCAEAQDG 240
ELD<u>X</u> 244

(iv) S-FC-X

<u>C</u>DKTHTCPPCPAPELLGGPSVFLFPPKPKDTLMISRTPEVTCVVVDVSHEDPEVKFNWYV 60
DGVEVHNAKTKPREEQYNSTYRVVSVLTVLHQDWLNGKEYKCKVSNKALPAPIEKTISKA 120
KGQPREPQVYTLPPSRDELTKNQVSLTCLVKGFYPSDIAVEWESNGQPENNYKTTPPVLD 180
SDGSFFLYSKLTVDKSRWQQGNVFSCSVMHEALHNHYTQKSLSLSPELQLEESCAEAQDG 240
ELDG<u>X</u> 245

FIG. 38B

Fc N-terminal-X-terminus AND C-terminal-X-terminus (i) PRE-Fc-AUTOCLEAVAGE

```
SHH     MLLLARCLLLVLVSSLLVCSGLA              -23
IFN     MALTFALLVALLVLSCKSSCSVG              -23
CETP           MLAATVLTLALLGNAHA             -17

CPPCPAPELLGGPSVFLFPPKPKDTLMISRTPEVTCVVVDVSHEDPEVKFNWYVDGVEVH      60
NAKTKPREEQYNSTYRVVSVLTVLHQDWLNGKEYKCKVSNKALPAPIEKTISKAKGQPRE     120
PQVYTLPPSRDELTKNQVSLTCLVKGFYPSDIAVEWESNGQPENNYKTTPPVLDSDGSFF     180
LYSKLTVDKSRWQQGNVFSCSVMHEALHNHYTQKSLSLSPELQLEESCAEAQDGELDGCV     240
SGDTIVMTSGGPRTVAELEGKPFTALIRGSGYPCPSGFFRTCERDVYDLRTREGHCLRLT     300
HDHRVLVMDGGLEWRAAGELERGDRLVMDDAAGEFPALATFRGLRGAGRQDVYDATVYGA     360
SAFTANGFIVHACGEQPGTGLNSGLTTNPGVSAWQVNTAYTAGQLVTYNGKTYKCLQPHT     420
SLAGWEPSNVPALWQLQ                                                437
```

(ii) S-Fc-AUTOCLEAVAGE

```
CPPCPAPELLGGPSVFLFPPKPKDTLMISRTPEVTCVVVDVSHEDPEVKFNWYVDGVEVH      60
NAKTKPREEQYNSTYRVVSVLTVLHQDWLNGKEYKCKVSNKALPAPIEKTISKAKGQPRE     120
PQVYTLPPSRDELTKNQVSLTCLVKGFYPSDIAVEWESNGQPENNYKTTPPVLDSDGSFF     180
LYSKLTVDKSRWQQGNVFSCSVMHEALHNHYTQKSLSLSPELQLEESCAEAQDGELDGCV     240
SGDTIVMTSGGPRTVAELEGKPFTALIRGSGYPCPSGFFRTCERDVYDLRTREGHCLRLT     300
HDHRVLVMDGGLEWRAAGELERGDRLVMDDAAGEFPALATFRGLRGAGRQDVYDATVYGA     360
SAFTANGFIVHACGEQPGTGLNSGLTTNPGVSAWQVNTAYTAGQLVTYNGKTYKCLQPHT     420
SLAGWEPSNVPALWQLQ                                                437
```

FIG. 39A

Fc N-terminal-x-terminus AND C-terminal-x-terminus (cont'd)

(iii) X-Fc-AUTOCLEAVAGE

```
XDKTHTCPPCPAPELLGGPSVFLFPPKPKDTLMISRTPEVTCVVVDVSHEDPEVKFNWYV    60
DGVEVHNAKTKPREEQYNSTYRVVSVLTVLHQDWLNGKEYKCKVSNKALPAPIEKTISKA   120
KGQPREPQVYTLPPSRDELTKNQVSLTCLVKGFYPSDIAVEWESNGQPENNYKTTPPVLD   180
SDGSFFLYSKLTVDKSRWQQGNVFSCSVMHEALHNHYTQKSLSLSPELQLEESCAEAQDG   240
ELDGCVSGDTIVMTSGGPRTVAELEGKPFTALIRGSGYPCPSGFFRTCERDVYDLRTREG   300
HCLRLTHDHRVLVMDGGLEWRAAGELERGDRLVMDDAAGEFPALATFRGLRGAGRQDVYD   360
ATVYGASAFTANGFIVHACGEQPGTGLNSGLTTNPGVSAWQVNTAYTAGQLVTYNGKTYK   420
CLQPHTSLAGWEPSNVPALWQLQ                                       443
```

(iv) X-Fc-THIOESTER

```
XDKTHTCPPCPAPELLGGPSVFLFPPKPKDTLMISRTPEVTCVVVDVSHEDPEVKFNWYV    60
DGVEVHNAKTKPREEQYNSTYRVVSVLTVLHQDWLNGKEYKCKVSNKALPAPIEKTISKA   120
KGQPREPQVYTLPPSRDELTKNQVSLTCLVKGFYPSDIAVEWESNGQPENNYKTTPPVLD   180
SDGSFFLYSKLTVDKSRWQQGNVFSCSVMHEALHNHYTQKSLSLSPELQLEESCAEAQDG   240
ELDX                                                          244
```

(v) X-Fc-X

```
XDKTHTCPPCPAPELLGGPSVFLFPPKPKDTLMISRTPEVTCVVVDVSHEDPEVKFNWYV    60
DGVEVHNAKTKPREEQYNSTYRVVSVLTVLHQDWLNGKEYKCKVSNKALPAPIEKTISKA   120
KGQPREPQVYTLPPSRDELTKNQVSLTCLVKGFYPSDIAVEWESNGQPENNYKTTPPVLD   180
SDGSFFLYSKLTVDKSRWQQGNVFSCSVMHEALHNHYTQKSLSLSPELQLEESCAEAQDG   240
ELDGX                                                         245
```

FIG. 39B

CD4 C-terminal-X-terminus (i) PRE-CD4-AUTOCLEAVAGE

```
                                               MNRGVPFRHLLLVLQLALLPAATQG   -25
KKVVLGKKGDTVELTCTASQKKSIQFHWKNSNQIKILGNQSFLTKGPSKLNDRADSRRS                 60
LWDQGNFPLIIKNLKIEDSDTYICEVEDQKEEVQLLVFGLTANSDTHLLQGQSLTLTLES                120
PPGSSPSVQCRSPRGKNIQGGKTLSVSQLELQDSGTWTCTVLQNQKKVEFKIDIVVLAFQ                180
KASSIVYKKEGEQVEFSFPLAFTVEKLTGSGELWWQAERASSSKSWITFDLKNKEVSVKR                240
VTQDPKLQMGKKLPLHLTLPQALPQYAGSGNLTLALEAKTGKLHQEVNLVVMRATQLQKN                300
LTCEVWGPTSPKLMLSLKLENKEAKVSKREKAVWVLNPEAGMWQCLLSDSGQVLLESNIK                360
VLPTWSTPVQPGCVSGDTIVMTSGGPRTVAELEGKPFTALIRGSGYPCPSGFFRTCERDV                420
YDLRTREGHCLRLTHDHRVLVMDGGLEWRAAGELERGDRLVMDDAAGEFPALATFRGLRG                480
AGRQDVYDATVYGASAFTANGFIVHACGEQPGTGLNSGLTTNPGVSAWQVNTAYTAGQLV                540
TYNGKTYKCLQPHTSLAGWEPSNVPALWQLQ                                             571
```

(ii) CD4-AUTOCLEAVAGE

```
KKVVLGKKGDTVELTCTASQKKSIQFHWKNSNQIKILGNQSFLTKGPSKLNDRADSRRS                 60
LWDQGNFPLIIKNLKIEDSDTYICEVEDQKEEVQLLVFGLTANSDTHLLQGQSLTLTLES                120
PPGSSPSVQCRSPRGKNIQGGKTLSVSQLELQDSGTWTCTVLQNQKKVEFKIDIVVLAFQ                180
KASSIVYKKEGEQVEFSFPLAFTVEKLTGSGELWWQAERASSSKSWITFDLKNKEVSVKR                240
VTQDPKLQMGKKLPLHLTLPQALPQYAGSGNLTLALEAKTGKLHQEVNLVVMRATQLQKN                300
LTCEVWGPTSPKLMLSLKLENKEAKVSKREKAVWVLNPEAGMWQCLLSDSGQVLLESNIK                360
VLPTWSTPVQPGCVSGDTIVMTSGGPRTVAELEGKPFTALIRGSGYPCPSGFFRTCERDV                420
YDLRTREGHCLRLTHDHRVLVMDGGLEWRAAGELERGDRLVMDDAAGEFPALATFRGLRG                480
AGRQDVYDATVYGASAFTANGFIVHACGEQPGTGLNSGLTTNPGVSAWQVNTAYTAGQLV                540
TYNGKTYKCLQPHTSLAGWEPSNVPALWQLQ                                             571
```

FIG. 40A

CD4 C-terminal-X-terminus (cont'd)

(iii) CD4-THIOESTER

KKVVLGKKGDTVELTCTASQKKSIQFHWKNSNQIKILGNQGSFLTKGPSKLNDRADSRRS 60
LWDQGNFPLIIKNLKIEDSDTYICEVEDQKEEVQLLVFGLTANSDTHLLQGQSLTLTLES 120
PPGSSPSVQCRSPRGKNIQGGKTLSVSQLELQDSGTWTCTVLQNQKKVEFKIDIVVLAFQ 180
KASSIVYKKEGEQVEFSFPLAFTVEKLTGSGELWQAERASSSKSWITFDLKNKEVSVKR 240
VTQDPKLQMGKKLPLHLTLPQALPQYAGSGNLTALEAKTGKLHQEVNLVVMRATQLQKN 300
LTCEVWGPTSPKLMLSLKLENKEAKVSKREKAVWVLNPEAGMWQCLLSDSGQVLLESNIK 360
VLPTWSTPVQPX 372

(iv) CD4-X

KKVVLGKKGDTVELTCTASQKKSIQFHWKNSNQIKILGNQGSFLTKGPSKLNDRADSRRS 60
LWDQGNFPLIIKNLKIEDSDTYICEVEDQKEEVQLLVFGLTANSDTHLLQGQSLTLTLES 120
PPGSSPSVQCRSPRGKNIQGGKTLSVSQLELQDSGTWTCTVLQNQKKVEFKIDIVVLAFQ 180
KASSIVYKKEGEQVEFSFPLAFTVEKLTGSGELWQAERASSSKSWITFDLKNKEVSVKR 240
VTQDPKLQMGKKLPLHLTLPQALPQYAGSGNLTALEAKTGKLHQEVNLVVMRATQLQKN 300
LTCEVWGPTSPKLMLSLKLENKEAKVSKREKAVWVLNPEAGMWQCLLSDSGQVLLESNIK 360
VLPTWSTPVQPGX 373

FIG. 40B

VH-CH1 C-terminal-x-terminus (i) PRE-Di62-VH-CH1-AUTOCLEAVAGE

```
                                                         MAWVWTLLFLMAAAQSIQA    -19
QIQLVQSGPELKKPGETVKISCKASGYTFTHYGMNWVKQAPGKGLKWMGWINTYTGEPTY                    60
ADDFKEHFAFSLETSASTVFLQINNLKNEDTATYFCARERGDAMDYWGQGTSVTVSSAST                    120
KGPSVFPLAPSSKSTSGGTAALGCLVKDYFPEPVTVSWNSGALTSGVHTFPAVLQSSGLY                    180
SLSSVVTVPSSSLGTQTYICNVNHKPSNTKVDKKVEPKSCDKTHTGCVSGDTIVMTSGGP                    240
RTVAELEGKPFTALIRGSGYPCPSGFFRTCERDVYDLRTHDHRVLVMDGGL                             300
EWRAAGELERGDRLVMDDAAGEFPALATFRGLRGAGRQDVYDATVYGASAFTANGFIVHA                    360
CGEQPGTGLNSGLTTNPGVSAWQVNTAYTAGQLVTYNGKTYKCLQPHTSLAGWEPSNVPA                    420
LWQLQ                                                                          425
```

(ii) Di62-VH-CH1-AUTOCLEAVAGE

```
QIQLVQSGPELKKPGETVKISCKASGYTFTHYGMNWVKQAPGKGLKWMGWINTYTGEPTY                    60
ADDFKEHFAFSLETSASTVFLQINNLKNEDTATYFCARERGDAMDYWGQGTSVTVSSAST                    120
KGPSVFPLAPSSKSTSGGTAALGCLVKDYFPEPVTVSWNSGALTSGVHTFPAVLQSSGLY                    180
SLSSVVTVPSSSLGTQTYICNVNHKPSNTKVDKKVEPKSCDKTHTGCVSGDTIVMTSGGP                    240
RTVAELEGKPFTALIRGSGYPCPSGFFRTCERDVYDLRTHDHRVLVMDGGL                             300
EWRAAGELERGDRLVMDDAAGEFPALATFRGLRGAGRQDVYDATVYGASAFTANGFIVHA                    360
CGEQPGTGLNSGLTTNPGVSAWQVNTAYTAGQLVTYNGKTYKCLQPHTSLAGWEPSNVPA                    420
LWQLQ                                                                          425
```

FIG. 41A

VH-CH1 C-terminal-x-terminus (cont'd)

(iii) Di62-VH-CH1-THIOESTER

QIQLVQSGPELKKPGETVKISCKASGYTFTHYGMNWVKQAPGKGLKWMGWINTYTGEPTY 60
ADDFKEHFAFSLETSASTVFLQINNLKNEDTATYFCARERGDAMDYWGQGTSVTVSSAST 120
KGPSVFPLAPSSKSTSGGTAALGCLVKDYFPEPVTVSWNSGALTSGVHTFPAVLQSSGLY 180
SLSSVVTVPSSSLGTQTYICNVNHKPSNTKVDKKVEPKSCDKTHTX 226

(iv) Di62-VH-CH1-X

QIQLVQSGPELKKPGETVKISCKASGYTFTHYGMNWVKQAPGKGLKWMGWINTYTGEPTY 60
ADDFKEHFAFSLETSASTVFLQINNLKNEDTATYFCARERGDAMDYWGQGTSVTVSSAST 120
KGPSVFPLAPSSKSTSGGTAALGCLVKDYFPEPVTVSWNSGALTSGVHTFPAVLQSSGLY 180
SLSSVVTVPSSSLGTQTYICNVNHKPSNTKVDKKVEPKSCDKTHTGX 227

FIG. 41B vk-ck (i) PRE-Di62-vk-ck

```
                                        MKSQTQVFVFLLLCVSGAHG    -20
SIVMTQTPKFLLVSAGDRVTITCTASQSVSNDVVWYQQKPGQSPKMLMYSAFNRYTGVPD     60
RFTGRGYGTDFTFTISSVQAEDLAVYFCQQDYNSPRTFGGGTKLEIKRTVAAPSVFIFPP    120
SDEQLKSGTASVVCLLNNFYPREAKVQWKVDNALQSGNSQESVTEQDSKDSTYSLSSTLT    180
LSKADYEKHKVYACEVTHQGLSSPVTKSFNRGEC                              214
```

(ii) Di62-vk-ck

```
SIVMTQTPKFLLVSAGDRVTITCTASQSVSNDVVWYQQKPGQSPKMLMYSAFNRYTGVPD     60
RFTGRGYGTDFTFTISSVQAEDLAVYFCQQDYNSPRTFGGGTKLEIKRTVAAPSVFIFPP    120
SDEQLKSGTASVVCLLNNFYPREAKVQWKVDNALQSGNSQESVTEQDSKDSTYSLSSTLT    180
LSKADYEKHKVYACEVTHQGLSSPVTKSFNRGEC                              214
```

FIG. 42

TNR1A C-terminal-X-terminus (i) PRE-TNR1A-AUTOCLEAVAGE

| | |
|---|---|
| MGLSTVPDLLLPLVLLELLVG | -21 |
| IYPSGVIGLVPHLGDREKRDSVCPQGKYIHPQNNSICCTKCHKGTYLYNDCPGPGQDTDC | 60 |
| RECESGSFTASENHLRHCLSCSKCRKEMGQVEISSCTVDRDTVCGCRKNQYRHYWSENLF | 120 |
| QCFNCSLCLNGTVHLSCQEKQNTVCTCHAGFFLRENECVSCSNCKKSLECTKLCLPQIEN | 180 |
| VKGTEDSGTTGCVSGDTIVMTSGGPRTVAELEGKPFTALIRGSGYPCPSGFFRTCERDVY | 240 |
| DLRTREGHCLRLTHDHRVLVMDGGLEWRAAGELERGDRLVMDDAAGEFPALATFRGLRGA | 300 |
| GRQDVYDATVYGASAFTANGFIVHACGEQPGTGLNSGLTTNPGVSAWQVNTAYTAGQLVT | 360 |
| YNGKTYKCLQPHTSLAGWEPSNVPALWQLQ | 390 |

(ii) TNR1A-AUTOCLEAVAGE

| | |
|---|---|
| IYPSGVIGLVPHLGDREKRDSVCPQGKYIHPQNNSICCTKCHKGTYLYNDCPGPGQDTDC | 60 |
| RECESGSFTASENHLRHCLSCSKCRKEMGQVEISSCTVDRDTVCGCRKNQYRHYWSENLF | 120 |
| QCFNCSLCLNGTVHLSCQEKQNTVCTCHAGFFLRENECVSCSNCKKSLECTKLCLPQIEN | 180 |
| VKGTEDSGTTGCVSGDTIVMTSGGPRTVAELEGKPFTALIRGSGYPCPSGFFRTCERDVY | 240 |
| DLRTREGHCLRLTHDHRVLVMDGGLEWRAAGELERGDRLVMDDAAGEFPALATFRGLRGA | 300 |
| GRQDVYDATVYGASAFTANGFIVHACGEQPGTGLNSGLTTNPGVSAWQVNTAYTAGQLVT | 360 |
| YNGKTYKCLQPHTSLAGWEPSNVPALWQLQ | 390 |

(iii) TNR1A-THIOESTER

| | |
|---|---|
| IYPSGVIGLVPHLGDREKRDSVCPQGKYIHPQNNSICCTKCHKGTYLYNDCPGPGQDTDC | 60 |
| RECESGSFTASENHLRHCLSCSKCRKEMGQVEISSCTVDRDTVCGCRKNQYRHYWSENLF | 120 |
| QCFNCSLCLNGTVHLSCQEKQNTVCTCHAGFFLRENECVSCSNCKKSLECTKLCLPQIEN | 180 |
| VKGTEDSGTTX | 191 |

(iv) TNR1A-X

| | |
|---|---|
| IYPSGVIGLVPHLGDREKRDSVCPQGKYIHPQNNSICCTKCHKGTYLYNDCPGPGQDTDC | 60 |
| RECESGSFTASENHLRHCLSCSKCRKEMGQVEISSCTVDRDTVCGCRKNQYRHYWSENLF | 120 |
| QCFNCSLCLNGTVHLSCQEKQNTVCTCHAGFFLRENECVSCSNCKKSLECTKLCLPQIEN | 180 |
| VKGTEDSGTTGX | 192 |

FIG. 43

TNR1B C-terminal-X-terminus (i) PRE-TNR1B-AUTOCLEAVAGE

```
                                                    MAPVAVWAALAVGLELWAAAHA         -22
LPAQVAFTPYAPEPGSTCRLREYYDQTAQMCCSKCSPGQHAKVFCTKTSDTVCDSCEDST                        60
YTQLWNWVPECLSCGSRCSSDQVETQACTREQNRICTCRPGWYCALSKQEGCRLCAPLRK                       120
CRPGFGVARPGTETSDVVCKPCAPGTFSNTTSSTDICRPHQICNVVAIPGNASMDAVCTS                       180
TSPTRSMAPGAVHLPQPVSTRSQHTQPTPEPSTAPSTSFLLPMGPSPPAEGSTGDGCVSG                       240
DTIVMTSGGPRTVAELEGKPFTALIRGSYPCPSGFFRTCERDVYDLRTREGHCLRLTHD                        300
HRVLVMDGGLEWRAAGELERGDRLVMDDAAGEFPALATFRGLRGAGRQDVYDATVYGASA                       360
FTANGFIVHACGEQPGTGLNSGLTTNPGVSAWQVNTAYTAGQLVTYNGKTYKCLQPHTSL                       420
AGWEPSNVPALWQLQ                                                                    435
```

(ii) TNR1B-AUTOCLEAVAGE

```
LPAQVAFTPYAPEPGSTCRLREYYDQTAQMCCSKCSPGQHAKVFCTKTSDTVCDSCEDST                        60
YTQLWNWVPECLSCGSRCSSDQVETQACTREQNRICTCRPGWYCALSKQEGCRLCAPLRK                       120
CRPGFGVARPGTETSDVVCKPCAPGTFSNTTSSTDICRPHQICNVVAIPGNASMDAVCTS                       180
TSPTRSMAPGAVHLPQPVSTRSQHTQPTPEPSTAPSTSFLLPMGPSPPAEGSTGDGCVSG                       240
DTIVMTSGGPRTVAELEGKPFTALIRGSYPCPSGFFRTCERDVYDLRTREGHCLRLTHD                        300
HRVLVMDGGLEWRAAGELERGDRLVMDDAAGEFPALATFRGLRGAGRQDVYDATVYGASA                       360
FTANGFIVHACGEQPGTGLNSGLTTNPGVSAWQVNTAYTAGQLVTYNGKTYKCLQPHTSL                       420
AGWEPSNVPALWQLQ                                                                    435
```

(iii) TNR1B-THIOESTER

```
LPAQVAFTPYAPEPGSTCRLREYYDQTAQMCCSKCSPGQHAKVFCTKTSDTVCDSCEDST                        60
YTQLWNWVPECLSCGSRCSSDQVETQACTREQNRICTCRPGWYCALSKQEGCRLCAPLRK                       120
CRPGFGVARPGTETSDVVCKPCAPGTFSNTTSSTDICRPHQICNVVAIPGNASMDAVCTS                       180
TSPTRSMAPGAVHLPQPVSTRSQHTQPTPEPSTAPSTSFLLPMGPSPPAEGSTGDX                            236
```

(iv) TNR1B-X

```
LPAQVAFTPYAPEPGSTCRLREYYDQTAQMCCSKCSPGQHAKVFCTKTSDTVCDSCEDST                        60
YTQLWNWVPECLSCGSRCSSDQVETQACTREQNRICTCRPGWYCALSKQEGCRLCAPLRK                       120
CRPGFGVARPGTETSDVVCKPCAPGTFSNTTSSTDICRPHQICNVVAIPGNASMDAVCTS                       180
TSPTRSMAPGAVHLPQPVSTRSQHTQPTPEPSTAPSTSFLLPMGPSPPAEGSTGDGX                           237
```

FIG. 44A

TNR1B-immunoadhesin (i) PRE-TNR1B-immunoadhesin

```
                                                          MAPVAVWAALAVGLELWAAAHA     -22
LPAQVAFTPYAPEPGSTCRLREYYDQTAQMCCSKCSPGQHAKVFCTKTSDTVCDSCEDST                         60
YTQLWNWVPECLSCGSRCSSDQVETQACTREQNRICTCRPGWYCALSKQEGCRLCAPLRK                         120
CRPGFGVARPGTETSDVVCKPCAPGTFSNTTSSTDICRPHQICNVVAIPGNASMDAVCTS                         180
TSPTRSMAPGAVHLPQPVSTRSQHTQPTPEPSTAPSTSFLLPMGPSPPAEGSTGDEPKSC                         240
DKTHTCPPCPAPELLGGPSVFLFPPKPKDTLMISRTPEVTCVVVDVSHEDPEVKFNWYVD                         300
GVEVHNAKTKPREEQYNSTYRVVSVLTVLHQDWLNGKEYKCKVSNKALPAPIEKTISKAK                         360
GQPREPQVYTLPPSRDELTKNQVSLTCLVKGFYPSDIAVEWESNGQPENNYKTTPPVLDS                         420
DGSFFLYSKLTVDKSRWQQGNVFSCSVMHEALHNHYTQKSLSLSPGK                                      467
```

(ii) TNR1B-immunoadhesin

```
LPAQVAFTPYAPEPGSTCRLREYYDQTAQMCCSKCSPGQHAKVFCTKTSDTVCDSCEDST                         60
YTQLWNWVPECLSCGSRCSSDQVETQACTREQNRICTCRPGWYCALSKQEGCRLCAPLRK                         120
CRPGFGVARPGTETSDVVCKPCAPGTFSNTTSSTDICRPHQICNVVAIPGNASMDAVCTS                         180
TSPTRSMAPGAVHLPQPVSTRSQHTQPTPEPSTAPSTSFLLPMGPSPPAEGSTGDEPKSC                         240
DKTHTCPPCPAPELLGGPSVFLFPPKPKDTLMISRTPEVTCVVVDVSHEDPEVKFNWYVD                         300
GVEVHNAKTKPREEQYNSTYRVVSVLTVLHQDWLNGKEYKCKVSNKALPAPIEKTISKAK                         360
GQPREPQVYTLPPSRDELTKNQVSLTCLVKGFYPSDIAVEWESNGQPENNYKTTPPVLDS                         420
DGSFFLYSKLTVDKSRWQQGNVFSCSVMHEALHNHYTQKSLSLSPGK                                      467
```

FIG. 44B

VGFR1 C-terminal-X-terminus

PRE-VGFR1-AUTOCLEAVAGE (i)
```
                                          MVSYWDTGVLLCALLSCLLLTGSSSG    -26
SKLKDPELSLKGTQHIMQAGQTLHLQCRGEAAHKWSLPEMVSKESERLSITKSACGRNGK            60
QFCSTLTLNTAQANHTGFYSCKYLAVPTSKKKETESAIYIFISDTGRPFVEMYSEIPEII           120
HMTEGRELVIPCRVTSPNITVTLKKFPLDTLIPDGKRIIWDSRKGFIISNATYKEIGLLT           180
CEATVNGHLYKTNYLTHRQTNTIIDVQISTPRPVKLLRGHTLVLNCTATTPLNTRVQMTW           240
SYPDEKNKRASVRRIDQSNSHANIFYSVLTIDKMQNKDKGLYTCRVRSGPSFKSVNTSV            300
HIYDKAFITVKHRKQQVLETVAGKRSYRLSMKVKAFPSPEVVWLKDGLPATEKSARYLTR           360
GYSLIIKDVTEEDAGNYTILLSIKQSNVFKNLTATLIVNVKPQIYEKAVSSFPDPALYPL           420
GSRQILTCTAYGIPQPTIKWFWHPCNHNHSEARCDFCSNNEESFILDADSNMGNRIESIT           480
QRMAIIEGKNKMASTLVVADSRISGIYICIASNKVGTVGRNISFYITDVPNGFHVNLEKM           540
PTEGEDLKLSCTVNKFLYRDVTWILLRTVNNRTMHYSISKQKMAITKEHSITLNLTIMNV           600
SLQDSGTYACRARNVYTGEEILQKKEITIRDQEAPYLLRNLSDHTVAISSSTTLDCHANG           660
VPEPQITWFKNNHKIQQEPGIILGPGSSTLFIERVTEEDEGVYHCKATNQKGSVESSAYL           720
TVQGTSDKSNLEGCVSGDTIVMTSGGPRTVAELEGKPFTALIRGSSGYPCPSGFFRTCERD          780
VYDLRTREGHCLRLTHDHRVLVMDGGLEWRAAGELERGDRLVMDDAAGEFPALATFRGLR           840
GAGRQDVYDATVYGASAFTANGFIVHACGEQPGTGLNSGLTTNPGVSAWQVNTAYTAGQL           900
VTYNGKTYKCLQPHTSLAGWEPSNVPALWQLQ                                       932
```

FIG. 45A

VGFR1 C-terminal-x-terminus (cont'd)

VGFR1-AUTOCLEAVAGE (ii)
```
SKLKDPELSLKGTQHIMQAGQTLHLQCRGEAAHKWSLPEMVSKESERLSITKSACGRNGK     60
QFCSTLTLNTAQANHTGFYSCKYLAVPTSKKKETESAIYIFISDTGRPFVEMYSEIPEII    120
HMTEGRELVIPCRVTSPNITVTLKKFPLDTLIPDGKRIIWDSRKGFIISNATYKEIGLLT    180
CEATVNGHLYKTNYLTHRQTNTIIDVQISTPRPVKLLRGHTLVLNCTATTPLNTRVQMTW    240
SYPDEKNKRASVRRIDQSNSHANIFYSVLTIDKMQNKDKGLYTCRVRSGPSFKSVNTSV    300
HIYDKAFITVKHRKQQVLETVAGKRSYRLSMKVKAFPSPEVVWLKDGLPATEKSARYLTR    360
GYSLIIKDVTEEDAGNYTILLSIKQSNVFKNLTATLIVNVKPQIYEKAVSSFPDPALYPL    420
GSRQILTCTAYGIPQPTIKWFWHPCNHNHSEARCDFCSNNEESFILDADSNMGNRIESIT    480
QRMAIIEGKNKMASTLVVADSRISGIYICIASNKVGTVGRNISFYITDVPNGFHVNLEKM    540
PTEGEDLKLSCTVNKFLYRDVTWILLRTVNNRTMHYSISKQKMAITKEHSITLNLTIMNV    600
SLQDSGTYACRARNVYTGEEILQKKEITIRDQEAPYLLRNLSDHTVAISSSTTLDCHANG    660
VPEPQITWFKNNHKIQQEPGIILGPGSSTLFIERVTEEDEGVYHCKATNQKGSVESSAYL    720
TVQGTSDKSNLEGCVSGDTIVMTSGGPRTVAELEGKPFTALIRGSGYPCPSGFFRTCERD    780
VYDLRTREGHCLRLTHDHRVLVMDGGLEWRAAGELERGDRLVMDDAAGEFPALATFRGLR    840
GAGRQDVYDATVYGASAFTANGFIVHACGEQPGTGLNSGLTNPGVSAWQVNTAYTAGQL    900
VTYNGKTYKCLQPHTSLAGWEPSNVPALWQLQ                                932
```

FIG. 45B

VGFR1 C-terminal-x-terminus (cont'd)

(iii) VGFR1-THIOESTER

```
SKLKDPELSLKGTQHIMQAGQTLHLQCRGEAAHKWSLPEMVSKESERLSITKSACGRNGK    60
QFCSTLTLNTAQANHTGFYSCKYLAVPTSKKKETESAIYIFISDTGRPFVEMYSEIPEII   120
HMTEGRELVIPCRVTSPNITVTLKKFPLDTLIPDGKRIIWDSRKGFIISNATYKEIGLLT   180
CEATVNGHLYKTNYLTHRQTNTIIDVQISTPRPVKLLRGHTLVLNCTATTPLNTRVQMTW   240
SYPDEKNKRASVRRRIDQSNSHANIFYSVLTIDKMQNKDKGLYTCRVRSGPSFKSVNTSV   300
HIYDKAFITVKHRKQQVLETVAGKRSYRLSMKVKAFPSPEVVWLKDGLPATEKSARYLTR   360
GYSLIIKDVTEEDAGNYTILLSIKQSNVFKNLTATLIVNVKPQIYEKAVSSFPDPALYPL   420
GSRQILTCTAYGIPQPTIKWFWHPCNHNHSEARCDFCSNNEESFILDADSNMGNRIESIT   480
QRMAIIEGKNKMASTLVVADSRISGIYICIASNKVGTVGRNISFYITDVPNGFHVNLEKM   540
PTEGEDLKLSCTVNKFLYRDVTWILLRTVNNRTMHYSISKQKMAITKEHSITLNLTIMNV   600
SLQDSGTYACRARNVYTGEEILQKKEITIRDQEAPYLLRNLSDHTVAISSSTTLDCHANG   660
VPEPQITWFKNNHKIQQEPGIILGPGSSTLFIERVTEEDEGVYHCKATNQKGSVESSAYL   720
TVQGTSDKSNLEX                                                  733
```

(iv) VGFR1-X

```
SKLKDPELSLKGTQHIMQAGQTLHLQCRGEAAHKWSLPEMVSKESERLSITKSACGRNGK    60
QFCSTLTLNTAQANHTGFYSCKYLAVPTSKKKETESAIYIFISDTGRPFVEMYSEIPEII   120
HMTEGRELVIPCRVTSPNITVTLKKFPLDTLIPDGKRIIWDSRKGFIISNATYKEIGLLT   180
CEATVNGHLYKTNYLTHRQTNTIIDVQISTPRPVKLLRGHTLVLNCTATTPLNTRVQMTW   240
SYPDEKNKRASVRRRIDQSNSHANIFYSVLTIDKMQNKDKGLYTCRVRSGPSFKSVNTSV   300
HIYDKAFITVKHRKQQVLETVAGKRSYRLSMKVKAFPSPEVVWLKDGLPATEKSARYLTR   360
GYSLIIKDVTEEDAGNYTILLSIKQSNVFKNLTATLIVNVKPQIYEKAVSSFPDPALYPL   420
GSRQILTCTAYGIPQPTIKWFWHPCNHNHSEARCDFCSNNEESFILDADSNMGNRIESIT   480
QRMAIIEGKNKMASTLVVADSRISGIYICIASNKVGTVGRNISFYITDVPNGFHVNLEKM   540
PTEGEDLKLSCTVNKFLYRDVTWILLRTVNNRTMHYSISKQKMAITKEHSITLNLTIMNV   600
SLQDSGTYACRARNVYTGEEILQKKEITIRDQEAPYLLRNLSDHTVAISSSTTLDCHANG   660
VPEPQITWFKNNHKIQQEPGIILGPGSSTLFIERVTEEDEGVYHCKATNQKGSVESSAYL   720
TVQGTSDKSNLEGX                                                 734
```

FIG. 45C

VGFR2 C-terminal-X-terminus (i) PRE-VGFR2-AUTOCLEAVAGE

```
                                                            MQSKVLLAVALWLCVETRA     -19
ASVGLPSVSLDLPRLSIQKDILTIKANTTLQITCRGQRDLDWLWPNNQSGSEQRVEVTEC                        60
SDGLFCKTLTIPKVIGNDTGAYKCFYRETDLASVIYVYVQDYRSPFIASVSDQHGVVYIT                       120
ENKNKTVVIPCLGSISNLNVSLCARYPEKRFVPDGNRISWDSKKGFTIPSYMISYAGMVF                       180
CEAKINDESYQSIMYIVVVGYRIYDVVLSPSHGIELSVGEKLVLNCTARTELNVGIDFN                        240
WEYPSSKHQHKKLVNRDLKTQSGSEMKKFLSTLTIDGVTRSDQGLYTCAASSGLMTKKNS                       300
TFVRVHEKPFVAFGSGMESLVEATVGERVRIPAKYLGYPPPEIKWYKNGIPLESNHTIKA                       360
GHVLTIMEVSERDTGNYTVILTNPISKEKQSHVVSLVVYPPQIGEKSLISPVDSYQYGT                        420
TQTLTCTVYAIPPPHHIHWYWQLEEECANEPSQAVSTNPYPCEEWRSVEDFQGGNKIEV                        480
NKNQFALIEGKNKTVSTLVIQAANVSALYKCEAVNKVGRGERVISFHVTRGPEITLQPDM                       540
QPTEQESVSLWCTADRSTFENLTWYKLGPQPLPIHVGELPTPVCKNLDTLWKLNATMFSN                       600
STNDILIMELKNASLQDQGDYVCLAQDRKTKKRHCVVRQLTVLERVAPTITGNLENQTTS                       660
IGESIEVSCTASGNPPPQIMWFKDNETLVEDSGIVLKDGNRNLTIRRVRKEDEGLYTCQA                       720
CSVLGCAKVEAFFIIEGAQEKTNLEGCVSGDTIVMTSGGPRTVAELEGKPFTALIRGSGY                       780
PCPSGFFRTCERDVYDLRTREGHCLRLTHDHRVLVMDGGLEWRAAGELERGDRLVMDDAA                       840
GEFPALATFRGLRGAGRQDVYDATVYGASAFTANGFIVHACGEQPGTGLNSGLTTNPGVS                       900
AWQVNTAYTAGQLVTYNGKTYKCLQPHTSLAGWEPSNVPALWQLQ                                      945
```

FIG. 46A

VGFR2 C-terminal-X-terminus (cont'd)

(ii) VGFR2-AUTOCLEAVAGE

```
ASVGLPSVSLDLPRLSIQKDILTIKANTTLQITCRGQRDLDWLWPNNQSGSEQRVEVTEC      60
SDGLFCKTLTIPKVIGNDTGAYKCFYRETDLASVIYVYVQDYRSPFIASVSDQHGVVYIT     120
ENKNKTVVIPCLGSISNLNVSLCARYPEKRFVPDGNRISWDSKKGFTIPSYMISYAGMVF     180
CEAKINDESYQSIMYIVVVGYRIYDVVLSPSHGIELSVGEKLVLNCTARTELNVGIDFN      240
WEYPSSKHQHKKLVNRDLKTQSGSEMKKFLSTLTIDGVTRSDQGLYTCAASSGLMTKKNS     300
TFVRVHEKPFVAFGSGMESLVEATVGERVRIPAKYLGYPPPEIKWYKNGIPLESNHTIKA     360
GHVLTIMEVSERDTGNYTVILTNPISKEKQSHVVSLVVYVPPQIGEKSLISPVDSYQYGT     420
TQTLTCTVYAIPPPHHIHWYWQLEEECANEPSQAVSVTNPYPCEEWRSVEDFQGGNKIEV     480
NKNQFALIEGKNKTVSTLVIQAANVSALYKCEAVNKVGRGERVISFHVTRGPEITLQPDM     540
QPTEQESVSLWCTADRSTFENLTWYKLGPQPLPIHVGELPTPVCKNLDTLWKLNATMFSN     600
STNDILIMELKNASLQDQGDYVCLAQDRKTKKRHCVVRQLTVLERVAPTITGNLENQTTS     660
IGESIEVSCTASGNPPPQIMWFKDNETLVEDSGIVLKDGMRNLTIRRVRKEDEGLYTCQA     720
CSVLGCAKVEAFFIIEGAQEKTNLEGCVSGDTIVMTSGGPRTVAELEGKPFTALIRGSGY     780
PCPSGFFRTCERDVYDLRTREGHCLRLTHDHRVLVMDGGLEWRAAGELERGDRLVMDDAA     840
GEFPALATFRGLRGAGRQDVYDATVYGASAFTANGFIVHACGEQPGTGLNSGLTTNPGVS     900
AWQVNTAYTAGQLVTYNGKTYKCLQPHTSLAGWEPSNVPALWQLQ                   945
```

FIG. 46B

VGFR2 C-terminal-x-terminus (cont'd)

(iii) VGFR2-THIOESTER

```
ASVGLPSVSLDLPRLSIQKDILTIKANTTLQITCRGQRDLDWLWPNNQSGSEQRVEVTEC        60
SDGLFCKTLTIPKVIGNDTGAYKCFYRETDLASVIYVYVQDYRSPFIASVSDQHGVVYIT       120
ENKNKTVVIPCLGSISNLNVSLCARYPEKRFVPDGNRISWDSKKGFTIPSYMISYAGMVF       180
CEAKINDESYQSIMYIVVVGYRIYDVLSPSHGIELSVGEKLVLNCTARTELNVGIDFN         240
WEYPSSKHQHKKLVNRDLKTQSGSEMKKFLSTLTIDGVTRSDQGLYTCAASSGLMTKKNS       300
TFVRVHEKPFVAFGSGMESLVEATVGERVRIPAKYLGYPPPEIKWYKNGIPLESNHTIKA       360
GHVLTIMEVSERDTGNYTVILTNPISKEKQSHVVSLVVYVPPQIGEKSLLISPVDSYQYGT     420
TQTLTCTVYAIPPPHHIHWYWQLEEECANEPSQAVSVTNPYPCEEWRSVEDFQGGNKIEV     480
NKNQFALIEGKNKTVSTLVIQAANVSALYKCEAVNKVGRGERVISFHVTRGPEITLQPDM      540
QPTEQESVSLWCTADRSTFENLTWYKLGPQPLPIHVGELPTPVCKNLDTLWKLNATMFSN      600
STNDILIMELKNASLQDQGDYVCLAQDRKTKKRHCVVRQLTVLERVAPTITGNLENQTTS       660
IGESIEVSCTASGNPPPQIMWFKDNETLVEDSGIVLKDGNRNLTIRRVRKEDEGLYTCQA     720
CSVLGCAKVEAFFIIEGAQEKTNLEX                                         746
```

(iv) VGFR2-X

```
ASVGLPSVSLDLPRLSIQKDILTIKANTTLQITCRGQRDLDWLWPNNQSGSEQRVEVTEC        60
SDGLFCKTLTIPKVIGNDTGAYKCFYRETDLASVIYVYVQDYRSPFIASVSDQHGVVYIT       120
ENKNKTVVIPCLGSISNLNVSLCARYPEKRFVPDGNRISWDSKKGFTIPSYMISYAGMVF       180
CEAKINDESYQSIMYIVVVGYRIYDVLSPSHGIELSVGEKLVLNCTARTELNVGIDFN         240
WEYPSSKHQHKKLVNRDLKTQSGSEMKKFLSTLTIDGVTRSDQGLYTCAASSGLMTKKNS       300
TFVRVHEKPFVAFGSGMESLVEATVGERVRIPAKYLGYPPPEIKWYKNGIPLESNHTIKA       360
GHVLTIMEVSERDTGNYTVILTNPISKEKQSHVVSLVVYVPPQIGEKSLLISPVDSYQYGT     420
TQTLTCTVYAIPPPHHIHWYWQLEEECANEPSQAVSVTNPYPCEEWRSVEDFQGGNKIEV     480
NKNQFALIEGKNKTVSTLVIQAANVSALYKCEAVNKVGRGERVISFHVTRGPEITLQPDM      540
QPTEQESVSLWCTADRSTFENLTWYKLGPQPLPIHVGELPTPVCKNLDTLWKLNATMFSN      600
STNDILIMELKNASLQDQGDYVCLAQDRKTKKRHCVVRQLTVLERVAPTITGNLENQTTS       660
IGESIEVSCTASGNPPPQIMWFKDNETLVEDSGIVLKDGNRNLTIRRVRKEDEGLYTCQA     720
CSVLGCAKVEAFFIIEGAQEKTNLEGX                                        747
```

FIG. 46C

VGFR3 C-terminal-X-terminus (i) PRE-VGFR3-AUTOCLEAVAGE

```
                                                          MQRGAALCLRLWLCLGLLDGLVSG    -24
YSMTPPTLNITEESHVIDTGDSLSISCRGQHPLEWAWPGAQEAPATGDKDSEDTGVVRDC              60
EGTDARPYCKVLLLHEVHANDTGSYVCYYKYIKARIEGTTAASSYVFVRDFEQPFINKPD             120
TLLVNRKDAMWVPCLVSIPGLNVTLRSQSSVLWPDGQEVVWDDRRGMLVSTPLLHDALYL             180
QCETTWGDQDFLSNPFLVHITGNELYDIQLLPRKSLELLVGEKLVLNCTVWAEFNSGVTF             240
DWDYPGKQAERGKWVPERRSQQTHTELSSILTIHNVSQHDLGSYVCKANNGIQRFRESTE             300
VIVHENPFISVEWLKGPILEATAGDELVKLPVKLAAYPPPEFQWYKDGKALSGRHSPHAL             360
VLKEVTEASTGTYTLALWNSAAGLRRNISLELVVNVPPQIHEKEASSPSIYSRHSRQALT             420
CTAYGVPLPLSIQWHWRPWTPCKMFAQRSLRRRQQQDLMPQCRDWRAVTTQDAVNPIESL             480
DTWTEFVEGKNKTVSKLVIQNANVSAMYKCVVSNKVGQDERLIYFVTTIPDGFTIESKP              540
SEELLEGQPVLLSCQADSYKYEHLRWYRLNLSTLHDAHGNPLLLDCKNVHLFATPLAASL             600
EEVAPGARHATLSLSIPRVAPEHEGHYCEVQDRRSHDKHCHKKYLSVQALEAPRLTQNL              660
TDLLVNVSDSLEMQCLVAGAHAPSIVWYKDERLLEEKSGVDLADSNQKLSIQRVREEDAG             720
RYLCSVCNAKGCVNSSASVAVEGSEDKGSMEGCVSGDTIVMTSGGPRTVAELEGKPFTAL             780
IRGSGYPCPSGFFRTCERDVYDLRTREGHCLRLTHDHRVLVMDGGLEWRAAGELERGDRL             840
VMDDAAGEFFPALATFRGLRGAGRQDVYDATVYGASAFTANGFIVHACGEQPGTGLNSGLT            900
TNPGVSAWQVNTAYTAGQLVTYNGKTYKCLQPHTSLAGWEPSNVPALWQLQ                      951
```

FIG. 47A

VGFR3 C-terminal-X-terminus (cont'd)

(ii) VGFR3-AUTOCLEAVAGE

```
YSMTPPTLNITEESHVIDTGDSLSISCRGQHPLEWAWPGAQEAPATGDKDSEDTGVVRDC    60
EGTDARPYCKVLLHEVHANDTGSYVCYYKYIKARIEGTTAASSYVFVRDFEQPFINKPD   120
TLLVNRKDAMWVPCLVSIPGLNVTLRSQSSVLWPDGQEVVWDDRRGMLVSTPLLHDALYL   180
QCETTWGDQDFLSNPFLVHITGNELYDIQLLPRKSLELLVGEKLVLNCTVWAEFNSGVTF   240
DWDYPGKQAERGKWVPERRSQQTHTELSSILTIHNVSQHDLGSYVCKANNGIQRFRESTE   300
VIVHENPFISVEWLKGPILEATAGDELVKLPVKLAAYPPPEFQWYKDGKALSGRHSPHAL   360
VLKEVTEASTGTYTLALWNSAAGLRRNISLELVVNVPPQIHEKEASSPSIYSRHSRQALT   420
CTAYGVPLPLSIQWHWRPWTPCKMFAQRSLRRQQQDLMPQCRDWRAVTTQDAVNPIESL   480
DTWTEFVEGKNKTVSKLVIQNANVSAMYKCVVSNKVGQDERLIYFVTTIPDGFTIESKP   540
SEELLEGQPVLLSCQADSYKYEHLRWYRLNLSTLHDAHGNPLLLDCKNVHLFATPLAASL   600
EEVAPGARHATLSLSIPRVAPEHEGHYVCEVQDRRSHDKHCHKKYLSVQALEAPRLTQNL   660
TDLLVNVSDSLEMQCLVAGAHAPSIVWYKDERLLEEKSGVDLADSNQKLSIQRVREEDAG   720
RYLCSVCNAKGCVNSSASVAVEGSEDKGSMEGCVSGDTIVMTSGGPRTVAELEGKPFTAL   780
IRGSGYPCPSGFFRTCERDVYDLRTREGHCLRLTHDHRVLVMDGGLEWRAAGELERGDRL   840
VMDDAAGEFPALATFRGLRGAGRQDVYDATVYGASAFTANGFIVHACGEQPGTGLNSGLT   900
TNPGVSAWQVNTAYTAGQLVTYNGKTYKCLQPHTSLAGWEPSNVPALWQLQ           951
```

FIG. 47B

VGFR3 C-terminal-X-terminus (cont'd)

(iii) VGFR3-THIOESTER

```
YSMTPPTLNITEESHVIDTGDSLSISCRGQHPLEWAWPGAQEAPATGDKSEDTGVVRDC     60
EGTDARPYCKVLLLHEVHANDTGSYVCYYKYIKARIEGTTAASSYVFVRDFEQPFINKPD    120
TLLVNRKDAMWVPCLVSIPGLNVTLRSQSSVLWPDGQEVVWDDRRGMLVSTPLLHDALYL    180
QCETTWGDQDFLSNPFLVHITGNELYDIQLLPRKSLELLVGEKLVLNCTWAEFNSGVTF     240
DWDYPGKQAERGKWVPERRSQQTHTELSSILTIHNVSQHDLGSYVCKANNGIQRFRESTE    300
VIVHENPFISVEWLKGPILEATAGDELVKLPVKLAAYPPPEFQWYKDGKALSGRHSPHAL    360
VLKEVTEASTGTYTLALWNSAAGLRRNISLELVVNVPPQIHEKEASSPSIYSRHSRQALT    420
CTAYGVPLPLSIQWHWRPWTPCKMFAQRSLRRQQQDLMPQCRDWRAVTTQDAVNPIESL     480
DTWTEFVEGKNKTVSKLVIQNANVSAMYKCVSNKVGQDERLIYFVTTIPDGFTIESKP     540
SEELLEGQPVLLSCQADSYKYEHLRWYRLNLSTLHDAHGNPLLLDCKNVHLFATPLAASL    600
EEVAPGARHATLSLSIPRVAPEHEGHYVCEVQDRRSHDKHCHKKYLSVQALEAPRLTQNL    660
TDLLVNVSDSLEMQCLVAGAHAPSIVWYKDERLLEEKSGVDLADSNQKLSIQRVREEDAG    720
RYLCSVCNAKGCVNSSASVAVEGSEDKGSMEX                                752
```

(iv) VGFR3-X

```
YSMTPPTLNITEESHVIDTGDSLSISCRGQHPLEWAWPGAQEAPATGDKSEDTGVVRDC     60
EGTDARPYCKVLLLHEVHANDTGSYVCYYKYIKARIEGTTAASSYVFVRDFEQPFINKPD    120
TLLVNRKDAMWVPCLVSIPGLNVTLRSQSSVLWPDGQEVVWDDRRGMLVSTPLLHDALYL    180
QCETTWGDQDFLSNPFLVHITGNELYDIQLLPRKSLELLVGEKLVLNCTWAEFNSGVTF     240
DWDYPGKQAERGKWVPERRSQQTHTELSSILTIHNVSQHDLGSYVCKANNGIQRFRESTE    300
VIVHENPFISVEWLKGPILEATAGDELVKLPVKLAAYPPPEFQWYKDGKALSGRHSPHAL    360
VLKEVTEASTGTYTLALWNSAAGLRRNISLELVVNVPPQIHEKEASSPSIYSRHSRQALT    420
CTAYGVPLPLSIQWHWRPWTPCKMFAQRSLRRQQQDLMPQCRDWRAVTTQDAVNPIESL     480
DTWTEFVEGKNKTVSKLVIQNANVSAMYKCVSNKVGQDERLIYFVTTIPDGFTIESKP     540
SEELLEGQPVLLSCQADSYKYEHLRWYRLNLSTLHDAHGNPLLLDCKNVHLFATPLAASL    600
EEVAPGARHATLSLSIPRVAPEHEGHYVCEVQDRRSHDKHCHKKYLSVQALEAPRLTQNL    660
TDLLVNVSDSLEMQCLVAGAHAPSIVWYKDERLLEEKSGVDLADSNQKLSIQRVREEDAG    720
RYLCSVCNAKGCVNSSASVAVEGSEDKGSMEGX                               753
```

FIG. 47C

ERBB1 C-terminal-X-terminus (i) PRE-ERBB1-AUTOCLEAVAGE

```
                                            MRPSGTAGAALLALLAALCPASRA         -24
LEEKKVCQGTSNKLTQLGTFEDHFLSLQRMFNNCEVVLGNLEITYVQRNYDLSFLKTIQE                  60
VAGYVLIALNTVERIPLENLQIIRGNMYYENSYALAVLSNYDANKTGLKELPMRNLQEIL                 120
HGAVRFSNNPALCNVESIQWRDIVSSDFLSNMSMDFQNHLGSCQKCDPSCPNGSCWGAGE                 180
ENCQKLTKIICAQQCSGRCRGKSPSDCCHNQCAAGCTGPRESDCLVCRKFRDEATCKDTC                 240
PPLMLYNPTTYQMDVNPEGKYSFGATCVKKCPRNYVVTDHGSCVRACGADSYEMEEDGVR                 300
KCKKCEGPCRKVCNGIGIGEFKDSLSINATNIKHFKNCTSISGDLHILPVAFRGDSFTHT                 360
PPLDPQELDILKTVKEITGFLLIQAWPENRTDLHAFENLEIIRGRTKQHGQFSLAVVSLN                 420
ITSLGLRSLKEISDGDVIISGNKNLCYANTINWKKLFGTSGQKTKIISNRGENSCKATGQ                 480
VCHALCSPEGCWGPEPRDCVSCRNVSRGRECVDKCNLLEGEPREFVENSECIQCHPECLP                 540
QAMNITCTGRGPDNCIQCAHYIDGPHCVKTCPAGVMGENNTLVWKYADAGHVCHLCHPNC                 600
TYGCTGPGLEGCPTNGPKIPSGCVSGDTIVMTSGGPRTVAELEGKPFTALIRGSYPCPS                  660
GFFRTCERDVDLRTREGHCLRLTHDHRVLMDGGLEWRAAGELERGDRLVMDDAAGEFP                   720
ALATFRGLRGAGRQDVYDATVYGASAFTANGFIVHACGEQPGTGLNSGLTTNPGVSAWQV                 780
NTAYTAGQLVTYNGKTYKCLQPHTSLAGWEPSNVPALWQLQ                                    821
```

(ii) ERBB1-AUTOCLEAVAGE

```
LEEKKVCQGTSNKLTQLGTFEDHFLSLQRMFNNCEVVLGNLEITYVQRNYDLSFLKTIQE                  60
VAGYVLIALNTVERIPLENLQIIRGNMYYENSYALAVLSNYDANKTGLKELPMRNLQEIL                 120
HGAVRFSNNPALCNVESIQWRDIVSSDFLSNMSMDFQNHLGSCQKCDPSCPNGSCWGAGE                 180
ENCQKLTKIICAQQCSGRCRGKSPSDCCHNQCAAGCTGPRESDCLVCRKFRDEATCKDTC                 240
PPLMLYNPTTYQMDVNPEGKYSFGATCVKKCPRNYVVTDHGSCVRACGADSYEMEEDGVR                 300
KCKKCEGPCRKVCNGIGIGEFKDSLSINATNIKHFKNCTSISGDLHILPVAFRGDSFTHT                 360
PPLDPQELDILKTVKEITGFLLIQAWPENRTDLHAFENLEIIRGRTKQHGQFSLAVVSLN                 420
ITSLGLRSLKEISDGDVIISGNKNLCYANTINWKKLFGTSGQKTKIISNRGENSCKATGQ                 480
VCHALCSPEGCWGPEPRDCVSCRNVSRGRECVDKCNLLEGEPREFVENSECIQCHPECLP                 540
QAMNITCTGRGPDNCIQCAHYIDGPHCVKTCPAGVMGENNTLVWKYADAGHVCHLCHPNC                 600
TYGCTGPGLEGCPTNGPKIPSGCVSGDTIVMTSGGPRTVAELEGKPFTALIRGSYPCPS                  660
GFFRTCERDVDLRTREGHCLRLTHDHRVLMDGGLEWRAAGELERGDRLVMDDAAGEFP                   720
ALATFRGLRGAGRQDVYDATVYGASAFTANGFIVHACGEQPGTGLNSGLTTNPGVSAWQV                 780
NTAYTAGQLVTYNGKTYKCLQPHTSLAGWEPSNVPALWQLQ                                    821
```

FIG. 48A

ERBB1 C-terminal-x-terminus (cont'd)

(iii) ERBB1-THIOESTER

```
LEEKKVCQGTSNKLTQLGTFEDHFLSLQRMFNCEVVLGNLEITYVQRNYDLSFLKTIQE      60
VAGYVLIALNTVERIPLENLQIIRGNMYYENSYALAVLSNYDANKTGLKELPMRNLQEIL    120
HGAVRFSNNPALCNVESIQWRDIVSSDFLSNMSDFQNHLGSCQKCDPSCPNGSCWGAGE     180
ENCQKLTKIICAQQCSGRCRGKSPSDCCHNQCAAGCTGPRESDCLVCRKFRDEATCKDTC    240
PPLMLYNPTTYQMDVNPEGKYSFGATCVKKCPRNYVVTDHGSCVRACGADSYEMEEDGVR    300
KCKKCEGPCRKVCNGIGIGEFKDSLSINATNIKHFKNCTSISGDLHILPVAFRGDSFTHT    360
PPLDPQELDILKTVKEITGFLLIQAWPENRTDLHAFENLEIIRGRTKQHGQFSLAVVSLN    420
ITSLGLRSLKEISDGDVIISGNKNLCYANTINWKKLFGTSGQKTKIISNRGENSCKATGQ    480
VCHALCSPEGCWGPEPRDCVSCRNVSRGRECVDKCNLLEGEPREFVENSECIQCHPECLP    540
QAMNITCTGRGPDNCIQCAHYIDGPHCVKTCPAGVMGENNTLVWKYADAGHVCHLCHPNC    600
TYGCTGPGLEGCPTNGKIPSX                                           622
```

(iv) ERBB1-X

```
LEEKKVCQGTSNKLTQLGTFEDHFLSLQRMFNCEVVLGNLEITYVQRNYDLSFLKTIQE      60
VAGYVLIALNTVERIPLENLQIIRGNMYYENSYALAVLSNYDANKTGLKELPMRNLQEIL    120
HGAVRFSNNPALCNVESIQWRDIVSSDFLSNMSDFQNHLGSCQKCDPSCPNGSCWGAGE     180
ENCQKLTKIICAQQCSGRCRGKSPSDCCHNQCAAGCTGPRESDCLVCRKFRDEATCKDTC    240
PPLMLYNPTTYQMDVNPEGKYSFGATCVKKCPRNYVVTDHGSCVRACGADSYEMEEDGVR    300
KCKKCEGPCRKVCNGIGIGEFKDSLSINATNIKHFKNCTSISGDLHILPVAFRGDSFTHT    360
PPLDPQELDILKTVKEITGFLLIQAWPENRTDLHAFENLEIIRGRTKQHGQFSLAVVSLN    420
ITSLGLRSLKEISDGDVIISGNKNLCYANTINWKKLFGTSGQKTKIISNRGENSECKATGQ   480
VCHALCSPEGCWGPEPRDCVSCRNVSRGRECVDKCNLLEGEPREFVENSECIQCHPECLP    540
QAMNITCTGRGPDNCIQCAHYIDGPHCVKTCPAGVMGENNTLVWKYADAGHVCHLCHPNC    600
TYGCTGPGLEGCPTNGKIPSGX                                          623
```

FIG. 48B

ERBB2 C-terminal-X-terminus (i) PRE-ERBB2-AUTOCLEAVAGE

```
                                                         MELAALCRWGLLLALLPPGAAS    -22
TQVCTGTDMKLRLPASPETHLDMLRHLYQGCQVVQGNLELTYLPTNASLSFLQDIQEVQG                        60
YVLIAHNQVRQVPLQRLRIVRGTQLFEDNYALAVLDNGDPLNNTTPVTGASPGGLRELQL                       120
RSLTEILKGGVLIQRNPQLCYQDTILWKDIFHKNNQLALTLIDTNRSRACHPCSPMCKGS                       180
RCWGESSEDCQSLTRTVCAGGCARCKGPLPTDCCHEQCAAGCTGPKHSDCLACLHFNHSG                       240
ICELHCPALVTYNTDTFESMPNPEGRYTFGASCVTACPYNYLSTDVGSCTLVCPLHNQEV                       300
TAEDGTQRCEKCSKPCARVCYGLGMEHLREVRAVTSANIQEFAGCKKIFGSLAFLPESFD                       360
GDPASNTAPLQPEQLQVFETLEEITGYLYISAWPDLSVFQNLQVIRGRILHNGAYS                           420
LTLQGLGISWLGLRSLRELGSGLALIHHNTHLCFVHTVPWDQLFRNPHQALLHTANRPED                       480
ECVGEGLACHQLCARGHCWGPGPTQCVNCSQFLRGQECVEECRVLQGLPREYVNARHCLP                       540
CHPECQPQNGSVTCFGPEADQCVACAHYKDPPFCVARCPSGVKPDLSYMPIWKFPDEEGA                       600
CQPCPINCTHSCVDLDDKGCPAEQRASPLTGCVSGDTIVMTSGGPRTVAELEGKPFTALI                       660
RGSGYPCPSGFFRTCERDVYDLRTREGHCLRLTHDHRVLVMDGGLEWRAAGELERGDRLV                       720
MDDAAGEFPALATFRGLRGAGRQDVYDATVYGASAFTANGFIVHACGEQPGTGLNSGLTT                       780
NPGVSAWQVNTAYTAGQLVTYNGKTYKCLQPHTSLAGWEPSNVPALWQLQ                                 830
```

(ii) ERBB2-AUTOCLEAVAGE

```
TQVCTGTDMKLRLPASPETHLDMLRHLYQGCQVVQGNLELTYLPTNASLSFLQDIQEVQG                        60
YVLIAHNQVRQVPLQRLRIVRGTQLFEDNYALAVLDNGDPLNNTTPVTGASPGGLRELQL                       120
RSLTEILKGGVLIQRNPQLCYQDTILWKDIFHKNNQLALTLIDTNRSRACHPCSPMCKGS                       180
RCWGESSEDCQSLTRTVCAGGCARCKGPLPTDCCHEQCAAGCTGPKHSDCLACLHFNHSG                       240
ICELHCPALVTYNTDTFESMPNPEGRYTFGASCVTACPYNYLSTDVGSCTLVCPLHNQEV                       300
TAEDGTQRCEKCSKPCARVCYGLGMEHLREVRAVTSANIQEFAGCKKIFGSLAFLPESFD                       360
GDPASNTAPLQPEQLQVFETLEEITGYLYISAWPDLSVFQNLQVIRGRILHNGAYS                           420
LTLQGLGISWLGLRSLRELGSGLALIHHNTHLCFVHTVPWDQLFRNPHQALLHTANRPED                       480
ECVGEGLACHQLCARGHCWGPGPTQCVNCSQFLRGQECVEECRVLQGLPREYVNARHCLP                       540
CHPECQPQNGSVTCFGPEADQCVACAHYKDPPFCVARCPSGVKPDLSYMPIWKFPDEEGA                       600
CQPCPINCTHSCVDLDDKGCPAEQRASPLTGCVSGDTIVMTSGGPRTVAELEGKPFTALI                       660
RGSGYPCPSGFFRTCERDVYDLRTREGHCLRLTHDHRVLVMDGGLEWRAAGELERGDRLV                       720
MDDAAGEFPALATFRGLRGAGRQDVYDATVYGASAFTANGFIVHACGEQPGTGLNSGLTT                       780
NPGVSAWQVNTAYTAGQLVTYNGKTYKCLQPHTSLAGWEPSNVPALWQLQ                                 830
```

FIG. 49A

ERBB2 C-terminal-X-terminus (cont'd)

(iii) ERBB2-THIOESTER

```
TQVCTGTDMKLRLPASPETHLDMLRHLYQGCQVVQGNLELTYLPTNASLSFLQDIQEVQG      60
YVLIAHNQVRQVPLQRLRIVRGTQLFEDNYALAVLDNGDPLNNTTPVTGASPGGLRELQL     120
RSLTEILKGGVLIQRNPQLCYQDTILWKDIFHKNNQLALTLIDTNRSRACHPCSPMCKGS     180
RCWGESSEDCQSLTRTVCAGGCARCKGPLPTDCCHEQCAAGCTGPKHSDCLACLHFNHSG     240
ICELHCPALVTYNTDTFESMPNPEGRYTFGASCVTACPYNYLSTDVGSCTLVCPLHNQEV     300
TAEDGTQRCEKCSKPCARVCYGLGMEHLREVRAVTSANIQEFAGCKKIFGSLAFLPESFD     360
GDPASNTAPLQPEQLQVFETLEEITGYLYISAWPDSLPDLSVFQNLQVIRGRILHNGAYS     420
LTLQGLGISWLGLRSLRELGSGLALIHHNTHLCFVHTVPWDQLFRNPHQALLHTANRPED     480
ECVGEGLACHQLCARGHCWGPGPTQCVNCSQFLRGQECVEECRVLQGLPREYVNARHCLP     540
CHPECQPQNGSVTCFGPEADQCVACAHYKDPPFCVARCPSGVKPDLSYMPIWKFPDEEGA     600
CQPCPINCTHSCVDLDDKGCPAEQRASPLTX                                 631
```

(iv) ERBB2-X

```
TQVCTGTDMKLRLPASPETHLDMLRHLYQGCQVVQGNLELTYLPTNASLSFLQDIQEVQG      60
YVLIAHNQVRQVPLQRLRIVRGTQLFEDNYALAVLDNGDPLNNTTPVTGASPGGLRELQL     120
RSLTEILKGGVLIQRNPQLCYQDTILWKDIFHKNNQLALTLIDTNRSRACHPCSPMCKGS     180
RCWGESSEDCQSLTRTVCAGGCARCKGPLPTDCCHEQCAAGCTGPKHSDCLACLHFNHSG     240
ICELHCPALVTYNTDTFESMPNPEGRYTFGASCVTACPYNYLSTDVGSCTLVCPLHNQEV     300
TAEDGTQRCEKCSKPCARVCYGLGMEHLREVRAVTSANIQEFAGCKKIFGSLAFLPESFD     360
GDPASNTAPLQPEQLQVFETLEEITGYLYISAWPDSLPDLSVFQNLQVIRGRILHNGAYS     420
LTLQGLGISWLGLRSLRELGSGLALIHHNTHLCFVHTVPWDQLFRNPHQALLHTANRPED     480
ECVGEGLACHQLCARGHCWGPGPTQCVNCSQFLRGQECVEECRVLQGLPREYVNARHCLP     540
CHPECQPQNGSVTCFGPEADQCVACAHYKDPPFCVARCPSGVKPDLSYMPIWKFPDEEGA     600
CQPCPINCTHSCVDLDDKGCPAEQRASPLTGX                                632
```

FIG. 49B

ERBB3 C-terminal-x-terminus (i) PRE-ERBB3-AUTOCLEAVAGE

```
                                                    MRANDALQVLGLLFSLARG    -19
SEVGNSQAVCPGTLNGLSVTGDAENQYQTLYKLYERCEVVMGNLEIVLTGHNADLSFLQW               60
IREVTGYVLVAMNEFSTLPLPNLRVVRGTQVYDGKFAIFVMLNYNTNSSHALRQLRLTQL              120
TEILSGGVYIEKNDKLCHMDTIDWRDIVRDRDAEIVVKDNGRSCPPCHEVCKGRCWGPGS              180
EDCQTLTKTICAPQCNGHCFGPNPNQCCHDECAGGCSGPQDTDCFACRHFNDSGACVPRC              240
PQPLVYNKLTFQLEPNPHTKYQYGGVCVASCPHNFVVDQTSCVRACPPDKMEVDKNGLKM              300
CEPCGGLCPKACEGTGSGSRFQTVDSSNIDGFVNCTKILGNLDFLITGLNGDPWHKIPAL              360
DPEKLNVFRTVREITGYLNIQSWPPHMHNFSVFSNLTTIGGRSLYNRGFSLLIMKNLNVT              420
SLGFRSLKEISAGRIYISANRQLCYHHSLNWTKVLRGPTEERLDIKHNRPRRDCVAEGKV              480
CDPLCSSGGCWGPGPGQCLSCRNYSRGGVCVTHCNFLNGEPREFAHEAECFSCHPECQPM              540
EGTATCNGSGSDTCAQCAHFRDGPHCVSSCPHGVLGAKGPIYKYPDVQNECRPCHENCTQ              600
GCKGPELQDCLGQTLVLIGKTHLTGCVSGDTIVMTSGGPRTVAELEGKPFTALIRGSGYP              660
CPSGFFRTCERDVYDLRTREGHCLRLTHDHRVLVMDGGLEWRAAGELERGDRLVMDDAAG              720
EFPALATFRGLRGAGRQDVYDATVYGASAFTANGFIVHACGEQPGTGLNSGLTTNPGVSA              780
WQVNTAYTAGQLVTYNGKTYKCLQPHTSLAGWEPSNVPALWQLQ                              824
```

(ii) ERBB3-AUTOCLEAVAGE

```
SEVGNSQAVCPGTLNGLSVTGDAENQYQTLYKLYERCEVVMGNLEIVLTGHNADLSFLQW               60
IREVTGYVLVAMNEFSTLPLPNLRVVRGTQVYDGKFAIFVMLNYNTNSSHALRQLRLTQL              120
TEILSGGVYIEKNDKLCHMDTIDWRDIVRDRDAEIVVKDNGRSCPPCHEVCKGRCWGPGS              180
EDCQTLTKTICAPQCNGHCFGPNPNQCCHDECAGGCSGPQDTDCFACRHFNDSGACVPRC              240
PQPLVYNKLTFQLEPNPHTKYQYGGVCVASCPHNFVVDQTSCVRACPPDKMEVDKNGLKM              300
CEPCGGLCPKACEGTGSGSRFQTVDSSNIDGFVNCTKILGNLDFLITGLNGDPWHKIPAL              360
DPEKLNVFRTVREITGYLNIQSWPPHMHNFSVFSNLTTIGGRSLYNRGFSLLIMKNLNVT              420
SLGFRSLKEISAGRIYISANRQLCYHHSLNWTKVLRGPTEERLDIKHNRPRRDCVAEGKV              480
CDPLCSSGGCWGPGPGQCLSCRNYSRGGVCVTHCNFLNGEPREFAHEAECFSCHPECQPM              540
EGTATCNGSGSDTCAQCAHFRDGPHCVSSCPHGVLGAKGPIYKYPDVQNECRPCHENCTQ              600
GCKGPELQDCLGQTLVLIGKTHLTGCVSGDTIVMTSGGPRTVAELEGKPFTALIRGSGYP              660
CPSGFFRTCERDVYDLRTREGHCLRLTHDHRVLVMDGGLEWRAAGELERGDRLVMDDAAG              720
EFPALATFRGLRGAGRQDVYDATVYGASAFTANGFIVHACGEQPGTGLNSGLTTNPGVSA              780
WQVNTAYTAGQLVTYNGKTYKCLQPHTSLAGWEPSNVPALWQLQ                              824
```

FIG. 50A

ERBB3 C-terminal-x-terminus (cont'd)

(iii) ERBB3-THIOESTER

```
SEVGNSQAVCPGTLNGLSVTGDAENQYQTLYKLYERCEVVMGNLEIVLTGHNADLSFLQW    60
IREVTGYVLVAMNEFSTLPLPNLRVVRGTQVYDGKFAIFVMLNYNTNSSHALRQLRLTQL   120
TEILSGGVYIEKNDKLCHMDTIDWRDIVRDAEIVVKDNGRSCPPCHEVCKGRCWGPGS     180
EDCQTLTKTICAPQCNGHCFGPNPNQCCHDECAGGCSGPQDTDCFACRHFNDSGACVPRC   240
PQPLVYNKLTFQLEPNPHTKYQYGGVCVASCPHNFVVDQTSCVRACPPDKMEVDKNGLKM   300
CEPCGGLCPKACEGTGSGSRFQTVDSSNIDGFVNCTKILGNLDFLITGLNGDPWHKIPAL   360
DPEKLNVFRTVREITGYLNIQSWPPHMHNFSVFSNLTTIGGRSLYNRGFSLLIMKNLNVT   420
SLGFRSLKEISAGRIYISANRQLCYHHSLNWTKVLRGPTEERLDIKHNRPRRDCVAEGKV   480
CDPLCSSGGCWGPGPGQCLSCRNYSRGGVCVTHCNFLNGEPREFAHEAECFSCHPECQPM   540
EGTATCNGSGSDTCAQCAHFRDGPHCVSSCPHGVLGAKGPIYKYPDVQNECRPCHENCTQ   600
GCKGPELQDCLGQTLVLIGKTHLTX                                     625
```

(iv) ERBB3-X

```
SEVGNSQAVCPGTLNGLSVTGDAENQYQTLYKLYERCEVVMGNLEIVLTGHNADLSFLQW    60
IREVTGYVLVAMNEFSTLPLPNLRVVRGTQVYDGKFAIFVMLNYNTNSSHALRQLRLTQL   120
TEILSGGVYIEKNDKLCHMDTIDWRDIVRDAEIVVKDNGRSCPPCHEVCKGRCWGPGS     180
EDCQTLTKTICAPQCNGHCFGPNPNQCCHDECAGGCSGPQDTDCFACRHFNDSGACVPRC   240
PQPLVYNKLTFQLEPNPHTKYQYGGVCVASCPHNFVVDQTSCVRACPPDKMEVDKNGLKM   300
CEPCGGLCPKACEGTGSGSRFQTVDSSNIDGFVNCTKILGNLDFLITGLNGDPWHKIPAL   360
DPEKLNVFRTVREITGYLNIQSWPPHMHNFSVFSNLTTIGGRSLYNRGFSLLIMKNLNVT   420
SLGFRSLKEISAGRIYISANRQLCYHHSLNWTKVLRGPTEERLDIKHNRPRRDCVAEGKV   480
CDPLCSSGGCWGPGPGQCLSCRNYSRGGVCVTHCNFLNGEPREFAHEAECFSCHPECQPM   540
EGTATCNGSGSDTCAQCAHFRDGPHCVSSCPHGVLGAKGPIYKYPDVQNECRPCHENCTQ   600
GCKGPELQDCLGQTLVLIGKTHLTGX                                    626
```

FIG. 50B

ERBB4 C-terminal-X-terminus (i) PRE-ERBB4-AUTOCLEAVAGE

```
                                                         MKPATGLWVWVSLLVAAGTVQPSDS    -25
QSVCAGTENKLSSLSDLEQQYRALRKYYENCEVVMGNLEITSIEHNRDLSFLRSVREVTG                          60
YVLVALNQFRYLPLENLRIIRGTKLYEDRYALAIFLNYRKDGNFGLQELGLKNLTEILNG                         120
GVYVDQNKFLCYADTIHWQDIVRNPWPSNLTLVSTNGSSGCGRCHKSCTGRCWGPTENHC                         180
QTLTRTVCAEQCDGRCYGPYVSDCCHRECAGGCSGPKDTDCFACMNFNDSGACVTQCPQT                         240
FVYNPTTFQLEHNFNAKYTYGAFCVKKCPHNFVVDSSSCVRACPSSKMEVEENGIKMCKP                         300
CTDICPKACDGIGTGSLMSAQTVDSSNIDKFINCTKINGNLIFLVTGIHGDPYNAIEAID                         360
PEKLNVFRTVREITGFLNIQSWPPNMTDFSVFSNLVTIGGRVLYSGLSLLILKQQGITSL                         420
QFQSLKEISAGNIYITDNSNLCYYHTINWTTLFSTINQRIVIRDNRKAENCTAEGMVCNH                         480
LCSSDGCWGPGPDQCLSCRRFSRGRICIESCNLYDGEFREFENGSICVECDPQCEKMEDG                         540
LLTCHGPGPDNCTKCSHFKDGPNCVEKCPDGLQGANSFIFKYADPDRECHPCHPNCTQGC                         600
NGPTSHDCIYYPWTGHSTLPQHARTPGCVSGDTIVMTSGGPRTVAELEGKPFTALIRGSG                         660
YPCPSGFFRTCERDVYDLRTREGHCLRLTHDHRVLVMDGGLEWRAAGELERGDRLVMDDA                         720
AGEFPALATFRGLRGAGRQDVYDATVYGASAFTANGFIVHACGEQPGTGLNSGLTTNPGV                         780
SAWQVNTAYTAGQLVTYNGKTYKCLQPHTSLAGWEPSNVPALWQLQ                                       826
```

(ii) ERBB4-AUTOCLEAVAGE

```
QSVCAGTENKLSSLSDLEQQYRALRKYYENCEVVMGNLEITSIEHNRDLSFLRSVREVTG                          60
YVLVALNQFRYLPLENLRIIRGTKLYEDRYALAIFLNYRKDGNFGLQELGLKNLTEILNG                         120
GVYVDQNKFLCYADTIHWQDIVRNPWPSNLTLVSTNGSSGCGRCHKSCTGRCWGPTENHC                         180
QTLTRTVCAEQCDGRCYGPYVSDCCHRECAGGCSGPKDTDCFACMNFNDSGACVTQCPQT                         240
FVYNPTTFQLEHNFNAKYTYGAFCVKKCPHNFVVDSSSCVRACPSSKMEVEENGIKMCKP                         300
CTDICPKACDGIGTGSLMSAQTVDSSNIDKFINCTKINGNLIFLVTGIHGDPYNAIEAID                         360
PEKLNVFRTVREITGFLNIQSWPPNMTDFSVFSNLVTIGGRVLYSGLSLLILKQQGITSL                         420
QFQSLKEISAGNIYITDNSNLCYYHTINWTTLFSTINQRIVIRDNRKAENCTAEGMVCNH                         480
LCSSDGCWGPGPDQCLSCRRFSRGRICIESCNLYDGEFREFENGSICVECDPQCEKMEDG                         540
LLTCHGPGPDNCTKCSHFKDGPNCVEKCPDGLQGANSFIFKYADPDRECHPCHPNCTQGC                         600
NGPTSHDCIYYPWTGHSTLPQHARTPGCVSGDTIVMTSGGPRTVAELEGKPFTALIRGSG                         660
YPCPSGFFRTCERDVYDLRTREGHCLRLTHDHRVLVMDGGLEWRAAGELERGDRLVMDDA                         720
AGEFPALATFRGLRGAGRQDVYDATVYGASAFTANGFIVHACGEQPGTGLNSGLTTNPGV                         780
SAWQVNTAYTAGQLVTYNGKTYKCLQPHTSLAGWEPSNVPALWQLQ                                       826
```

FIG. 51A

ERBB4 C-terminal-x-terminus (cont'd)

(iii) ERBB4-THIOESTER

```
QSVCAGTENKLSSLSDLEQQYRALRKYYENCEVVMGNLEITSIEHNRDLSFLRSVREVTG    60
YVLVALNQFRYLPLENLRIIRGTKLYEDRYALAIFLNYRKDGNFGLQELGLKNLTEILNG   120
GVYVDQNKFLCYADTIHWQDIVRNPWPSNLTLVSTNGSSGCRCHKSCTGRCWGPTENHC    180
QTLRTVCAEQCDGRCYGPYVSDCCHRECAGGCSGPKDTDCFACMNFNDSGACVTQCPQT    240
FVYNPTTFQLEHNFNAKYTYGAFCVKKCPHNFVVDSSSCVRACPSSKMEVEENGIKMCKP    300
CTDICPKACDGIGTGSLMSAQTVDSSNIDKFINCTKNGNLIFLVTGIHGDPYNAIEAID    360
PEKLNVFRTVREITGFLNIQSWPPNMTDFSVFSNLVTIGGRVLYSGLSLLILKQQGITSL   420
QFQSLKEISAGNIYITDNSNLCYYHTINWTTLFSTINQRIVIRDNRKAENCTAEGMVCNH   480
LCSSDGCWGPGPDQCLSCRRFSRGRICIESCNLYDGEFREFENGSICVECDPQCEKMEDG   540
LLTCHGPGPDNCTKCSHFKDGPNCVEKCPDGLQGANSFIFKYADPDRECHPCHPNCTQGC   600
NGPTSHDCIYPWTGHSTLPQHARTPX                                    627
```

(iv) ERBB4-X

```
QSVCAGTENKLSSLSDLEQQYRALRKYYENCEVVMGNLEITSIEHNRDLSFLRSVREVTG    60
YVLVALNQFRYLPLENLRIIRGTKLYEDRYALAIFLNYRKDGNFGLQELGLKNLTEILNG   120
GVYVDQNKFLCYADTIHWQDIVRNPWPSNLTLVSTNGSSGCRCHKSCTGRCWGPTENHC    180
QTLRTVCAEQCDGRCYGPYVSDCCHRECAGGCSGPKDTDCFACMNFNDSGACVTQCPQT    240
FVYNPTTFQLEHNFNAKYTYGAFCVKKCPHNFVVDSSSCVRACPSSKMEVEENGIKMCKP    300
CTDICPKACDGIGTGSLMSAQTVDSSNIDKFINCTKNGNLIFLVTGIHGDPYNAIEAID    360
PEKLNVFRTVREITGFLNIQSWPPNMTDFSVFSNLVTIGGRVLYSGLSLLILKQQGITSL   420
QFQSLKEISAGNIYITDNSNLCYYHTINWTTLFSTINQRIVIRDNRKAENCTAEGMVCNH   480
LCSSDGCWGPGPDQCLSCRRFSRGRICIESCNLYDGEFREFENGSICVECDPQCEKMEDG   540
LLTCHGPGPDNCTKCSHFKDGPNCVEKCPDGLQGANSFIFKYADPDRECHPCHPNCTQGC   600
NGPTSHDCIYPWTGHSTLPQHARTPGX                                   628
```

FIG. 51B

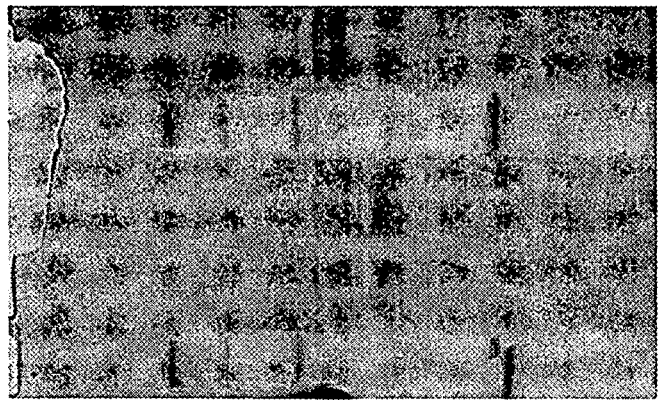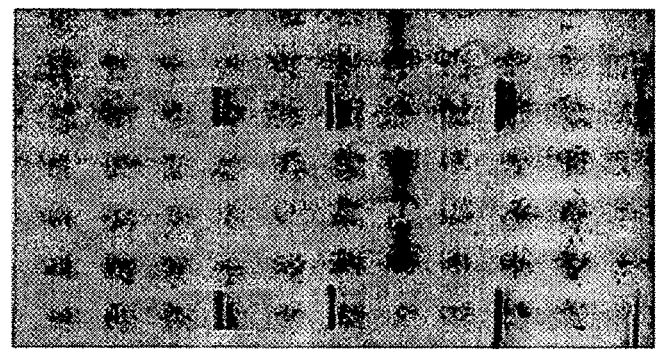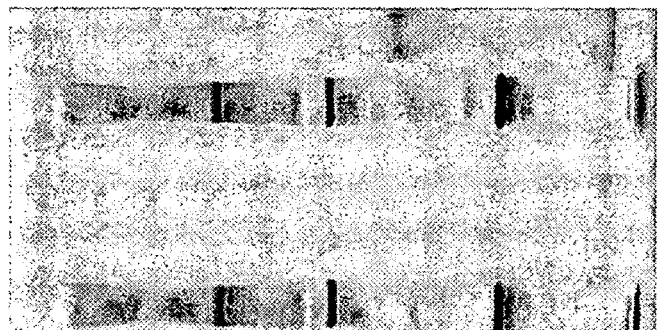
Fig. 58

HYBRID IMMUNOGLOBULINS WITH MOVING PARTS

This application is a continuation of U.S. Ser. No. 11/982,085, filed Oct. 31, 2007, which claims benefit of U.S. Provisional Application No. 60/856,864, filed Nov. 2, 2006, the contents of which are hereby incorporated by reference into this application.

Throughout this application, various publications are referenced. The disclosures of these publications in their entireties are hereby incorporated by reference into this application in order to more fully describe the state of the art as known to those skilled therein as of the date of the invention described and claimed herein.

BACKGROUND OF THE INVENTION

All machines and devices have moving parts. The function of the moving parts is to perform work, by transforming a source of energy, in order to carry out a useful task. Moving parts cover a spectrum of sizes and shapes. At one end of the spectrum is a visible world evident in machines that perform mechanical tasks. At the other end of the spectrum is an invisible world of charge carriers utilized by devices that carry out electrical work.

This spectrum is so vast that certain of its regions have only begun to be technologically exploited. Among these are devices with moving parts of several nano-meters to several hundred nano-meters. This size range holds considerable interest to many scientists and engineers because it is comparable to the very size of molecules, the fundamental units of chemical matter. Nano-machines have the potential to exploit the unique properties of molecules, such as intermolecular binding or catalysis.

The ability to make molecules of any imaginable size and shape is one activity crucial in building nano-machines. As such it has been widely anticipated in medicine, electronics, optics, and many other fields. Tremendous commercial activity has been focused on the synthesis very large numbers of chemically distinct molecules. However, molecular configuration (differences in bonding) is just one practical means of generating diversity. Molecular conformation (differences in bond rotation) offers another important avenue for generating a universe of continuous size and shape.

Molecular conformation has certain unique advantages in strategies for creating molecules with moving parts. While atoms and chemical bonds have precise linear and angular dimensions, conformational change can provide limitless variation in the size and shape of molecules. Covalent and non-covalent chemical bonds both afford rotational degrees of freedom. Dihedral rotation around each of a series of bonds connecting distinct parts (domains) of a molecule is capable of providing the essential dynamic ingredient of nano-machines.

In general, any two given atoms interconnected by a single bond (i.e., a single electron pair) can rotate fully 360 degrees with respect to each other and with respect to the other atoms that each is bonded to. A series of consecutive single bonds is like a series of interconnected ball joints. Although limited to rotary motions, a series of consecutive single bonds, like a series of consecutive ball joints, can recapitulate the movement of other types of interconnected moving parts (e.g., a series of consecutive hinges).

One challenging aspect of creating useful nano-machines is striking a balance in the number of moving parts and the number of interconnections. Above a certain threshold, increasing the number of parts or connections in any machine is counterproductive. Thus automobile engines employ an optimal number of pistons, valves, camshafts, pulleys, and so forth.

The analogous challenge in the chemical field is illustrated by two related, but very different types of molecules, namely organic and biological polymers. A good comparison is provided by polyethylene and proteins. Polyethylenes are stretches of consecutive ethylenes, $(CH_2)_n$, interconnected by consecutive single bonds $(-C-)_n$, while proteins are stretches of consecutive amino acids, $(NHCHRCO)_n$, interconnected by consecutive peptide bonds $(=N-C-C=)_n$. Unbranched polyethylenes are repeating chains of single bonds, while proteins are repeating chains of one double bond followed by two single bonds. The most important difference between these two types of chains is that polyethylene can adopt almost any conformation and thus has no definite size or shape (only a statistically averaged one), while proteins are extremely rigid and thus have very definite (and unchanging) size and shape.

A simple but reasonable comparison to a mechanical device would represent polyethylene as a machine with a high ratio of moving parts to connections, and a protein as a machine with an low ratio of moving parts to connections. Neither molecule is very suited to a machine-like task unless one takes advantage of higher order structures that each can form. For example, polyethylene is useful when its ability to form intermolecular fibers is exploited. Interesting, the ability of polyethylene to display such tertiary structure depends upon its inherent flexibility. Although some proteins can form fibers of commercial value (e.g., silk, wool and collagen), most proteins are globular and do not.

Globular proteins are, for nearly all practical purposes, machines with few if any moving parts, like a crowbar that must exert its leverage in combination with other objects, such as the human that wields it and the objects against which it is wedged. Notwithstanding, there are many instances in which there would be great value to protein-like molecules having distinct regions (e.g., binding domains) that are joined together in some manner permitting relative, yet coordinated movement. One example would be protein-like molecules capable of cooperatively binding a disease target having two or more identical binding sites. This would take full advantage of the unique properties of globular protein binding domains, namely their great specificity for targets, particularly other proteins associated with disease.

The potential commercial value of protein-like molecules that are able to cooperatively bind a disease target may be estimated quantitatively. A starting assumption is that most therapeutics in current use, whether small molecules or biopharmaceuticals, typically bind their targets non-cooperatively with affinity constants on the order of nano-molar ($10^{-9}$ M). Remarkably, a cooperative therapeutic could conceivably bind the same target, with an affinity of nano-molar×nano-molar ($10^{-9}$ M×$10^{-9}$ M) [i.e., atto-molar ($10^{-18}$ M)].

Because therapeutics are typically required in great molar excess over their targets (about one million-fold), a cooperative therapeutic would thus be equivalent to a non-cooperative therapeutic at a $10^{-6}$ smaller dose. For many current biopharmaceuticals (e.g. antibodies and immunoadhesins) this difference amounts to 1 microgram per single dose instead of 1 gram per single dose. With patient costs exceeding $1,000 per gram, this factor has great significance in new drug discovery and development as well as for existing biopharmaceuticals.

One irony associated with antibodies and immunoadhesins is that while they are symmetric proteins having two identical binding domains, they do not generally bind symmetrically to symmetric targets. The inflexible connections between the two binding domains do not provide the machine-like motion that would permit cooperative binding. Numerous attempts to engineer antibodies and immunoadhesins that bind symmetrically have failed because of the difficulty in achieving the precise geometry needed for complementary symmetries between the binding sites and target sites. Unlike materials used to make conventional machines, such as wood, metals, plastics, ceramics, and the like, molecules cannot simply be cut, wrought, cast, machined or joined to an exact size and shape.

While cooperative binding is thus not readily achieved with any single fixed size and shape, conformational flexibility between binding domains does provides a potential solution. A "one size fits all" strategy is based upon the proposition that a protein-like molecule with binding domains that move symmetrically will also be capable of binding symmetrically (i.e., cooperativity). The binding domains are driven thermodynamically into a conformation most compatible with simultaneous binding of both target sites because it represents the energetically favored conformational minima.

SUMMARY OF THE INVENTION

In an embodiment this invention provides a compound comprising a first stretch of consecutive amino acids, each of which is joined to the preceding amino acid by a peptide bond and the sequence of which comprises a binding site for a target; and a second stretch of consecutive amino acids, each of which is joined to the preceding amino acid by a peptide bond and the sequence of which is identical to the sequence of the first stretch of consecutive amino acids and which comprises an identical binding site for the target; wherein each of the first stretch of amino acids and the second stretch of amino acids has at a predefined end thereof a cysteine residue or a selenocysteine residue and such cysteine residues or such selenocysteine residues are joined by a bond having the structure:

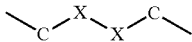

wherein each X is the same and represents a sulfur (S) or a selenium (Se) and each C represents a beta-carbon of one of such cysteine or selenocysteine residues.

In an embodiment this invention also provides a compound comprising a first stretch of consecutive amino acids, each of which is joined to the preceding amino acid by a peptide bond and the sequence of which comprises a binding site for a target; and a second stretch of consecutive amino acids, each of which is joined to the preceding amino acid by a peptide bond and the sequence of which is different from the sequence of the first stretch of consecutive amino acids and which comprises a binding site for a different moiety; wherein each of the first stretch of amino acids and the second stretch of amino acids has at a predefined end thereof a cysteine residue or a selenocysteine residue and such residues are joined by a bond having the structure:

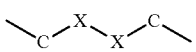

wherein each X may be the same or different and represents a sulfur (S) or a selenium (Se) and each C represents a beta-carbon of one of such cysteine or selenocysteine residues.

Genetic devices disclosed herein comprise two or more stretches of consecutive amino acids that are connected at a predefined terminus by a non-peptide bond. Such genetic devices are both symmetric and symmetrically binding with respect to one or more important targets (i.e., cooperative). The genetic devices herein are protein-like molecules may be described by a number of related terms that include symmetroadhesins, immuno-symmetroadhesins, hemi-symmetroadhesins, and bi-symmetroadhesins [meaning "stick to proportionately," from the Gk. symmetros "having a common measure, even, proportionate," and the L. adhaerentem, prp. of adhaerere "stick to"].

Disclosed herein is a compound comprising two or more independently-folding protein domains linked to one another through one or more non-peptide bonds, around which bond(s) dihedral rotation may occur.

BRIEF DESCRIPTION OF THE FIGURES

FIG. 1: Stretches of consecutive amino acids, with one X-terminus, depicting positions of N-, C-, S-, and Se-termini. N-terminal and C-terminal amino acid residues, drawn as a Newman-style projection, are shown above and below the projection plane, respectively: (i) A stretch of consecutive amino acids (generalized structure), having, an N-terminal amino acid residue (sidechain=R1) having a free α-amino (NH$_2$) group, and a C-terminal amino acid residue (sidechain=Rn) having a free α-carboxyl (COOH) group. (ii) A stretch of consecutive amino acids, with N-terminal S-terminus, having, an N-terminal cysteine having free α-amino (NH$_2$) and β-sulfhydryl (SH) groups, and a C-terminal amino acid residue having a free α-carboxyl (COOH) group. (iii) A stretch of consecutive amino acids, with C-terminal S-terminus, having, an N-terminal amino acid residue having a free α-amino (NH$_2$) group, and a C-terminal cysteine having free α-carboxyl (COOH) and β-sulfhydryl (SH) groups. (iv) A stretch of consecutive amino acids, with N-terminal Se-terminus, having, an N-terminal selenocysteine having free α-amino (NH$_2$) and β-selenohydryl (SeH) groups, and a C-terminal amino acid residue having a free α-carboxyl (COOH) group. (v) A stretch of consecutive amino acids, with C-terminal Se-terminus, having, a N-terminal amino acid residue having a free α-amino (NH$_2$) group, and a C-terminal selenocysteine having free α-carboxyl (COOH) and β-selenohydryl (SeH) groups.

FIG. 2: Stretches of consecutive amino acids, with two X-termini, depicting positions of N-, C-, S-, and Se-termini. N-terminal and C-terminal amino acid residues, drawn as a Newman-style projection, are shown above and below the projection plane, respectively. A stretch of consecutive amino acids, with two X-termini (generalized structure), having, an N-terminal amino acid residue (sidechain=X1) having a free α-amino (NH$_2$) group, and a C-terminal amino acid residue (sidechain=Xn) having a free α-carboxyl (COOH) group. (ii) A stretch of consecutive amino acids, with N-terminal S-terminus and C-terminal S-terminus, having, an N-terminal cysteine having free α-amino (NH$_2$) and β-sulfhydryl (SH) groups, and a C-terminal cysteine having free α-carboxyl (COOH) and β-sulfhydryl (SH) groups. (iii) A stretch of consecutive amino acids, with N-terminal S-terminus and C-terminal Se-terminus, having, an N-terminal cysteine having free α-amino (NH$_2$) and β-sulfhydryl (SH) groups, and a C-terminal selenocysteine having free α-carboxyl (COOH) and β-selenohydryl (SeH) groups. (iv) A stretch of consecutive amino acids, with N-terminal Se-terminus and C-terminal S-terminus, having, an N-terminal selenocysteine having free α-amino ($NH_2$) and β-selenohydryl (SeH) groups, and a C-terminal cysteine having free α-carboxyl (COOH) and β-sulfhydryl (SH) groups. (v) A stretch of consecutive amino acids, with N-terminal Se-terminus and C-terminal Se-terminus, having, an N-terminal selenocysteine having free α-amino ($NH_2$) and β-selenohydryl (SeH) groups, and a C-terminal selenocysteine having free α-carboxyl (COOH) and β-selenohydryl (SeH) groups.

FIG. 35A: Amino acid sequences of various polypeptide synthetic intermediates of a human IgG1 Fc symmetroadhesin precursor subunit with an N-terminal-S-terminus. Part (i) shows three distinct pre-Fc polypeptides comprising, alternatively, the human sonic hedgehog (SHH), human interferon alpha-2 (IFN), or human cholesterol ester transferase (CETP) signal sequences (residues −23 to −1, −23 to −1, or −17 to −1, respectively), and the human IGHG1 Fc domain (residues 1 to 228) beginning at the fifth amino acid encoded by the hinge exon, CDKTHTCPPCP (Ellison et al. (1982) Nuc. Acids Res. 10, 4071-4079). The three distinct pre-Fc polypeptides have lengths of 251, 251 and 245 residues, respectively. Part (ii) shows the mature Fc domain (length=228) with an N-terminal-S-terminus. The N-terminal cysteine residue is underlined. (IGHG1, UniProtKB/Swiss-Prot entry P01857, Ig gamma-1 chain C region, *Homo sapiens*).

FIG. 35B: Amino acid sequences of various polypeptide synthetic intermediates of a human IgG2 Fc symmetroadhesin precursor subunit with an N-terminal-S-terminus. Part (i) shows three distinct pre-Fc polypeptides comprising, alternatively, the human sonic hedgehog (SHH), human interferon alpha-2 (IFN), or human cholesterol ester transferase (CETP) signal sequences (residues −23 to −1, −23 to −1, or −17 to −1, respectively), and the human IGHG2 Fc domain (residues 1 to 225) beginning at the fourth amino acid encoded by the hinge exon, CCVECPPCP (Ellison et al. (1982) Nuc. Acids Res. 10, 4071-4079). The three distinct pre-Fc polypeptides have lengths of 248, 248 and 242 residues, respectively. Part (ii) shows the mature Fc domain (length=225) with an N-terminal-S-terminus. The N-terminal cysteine residue is underlined. (IGHG2, UniProtKB/Swiss-Prot entry P01859, Ig gamma-2 chain C region, *Homo sapiens*).

FIG. 35C: Amino acid sequences of various polypeptide synthetic intermediates of a human IgG3 Fc symmetroadhesin precursor subunit with an N-terminal-S-terminus. Part (i) shows three distinct pre-Fc polypeptides comprising, alternatively, the human sonic hedgehog (SHH), human interferon alpha-2 (IFN), or human cholesterol ester transferase (CETP) signal sequences (residues −23 to −1, −23 to −1, or −17 to −1, respectively), and the human IGHG3 Fc domain (residues 1 to 267) beginning at the thirteenth amino acid encoded by the first hinge exon, CPRCP (Strausberg et al. (2002) Proc. Natl. Acad. Sci. 99, 16899-1690). The three distinct pre-Fc polypeptides have lengths of 290, 290 and 284 residues, respectively. Part (ii) shows the mature Fc domain (length=267) with an N-terminal-S-terminus. The N-terminal cysteine residue is underlined. (IGHG3, UniProtKB/Swiss-Prot entry Q8N4Y9, Ig gamma-3 chain C region, *Homo sapiens*).

FIG. 35D: Amino acid sequences of various polypeptide synthetic intermediates of a human IgG4 Fc symmetroadhesin precursor subunit with an N-terminal-S-terminus. Part shows three distinct pre-Fc polypeptides comprising, alternatively, the human sonic hedgehog (SHH), human interferon alpha-2 (IFN), or human cholesterol ester transferase (CETP) signal sequences (residues −23 to −1, −23 to −1, or −17 to −1, respectively), and the human IGHG4 Fc domain (residues 1 to 222) beginning at the eighth amino acid encoded by the hinge exon, CPSCP (Strausberg et al. (2002) Proc. Natl. Acad. Sci. 99, 16899-1690). The three distinct pre-Fc polypeptides have lengths of 245, 245 and 239 residues, respectively. Part (ii) shows the mature Fc domain (length=222) with an N-terminal-S-terminus. The N-terminal cysteine residue is underlined. (IGHG4, UniProtKB/Swiss-Prot entry Q8TC63, Ig gamma-4 chain C region, *Homo sapiens*).

FIG. 36A: Amino acid sequences of various polypeptide synthetic intermediates of a human Fc symmetroadhesin precursor subunit with an N-terminal-X-terminus. Part (i) shows three distinct pre-Fc polypeptides comprising, alternatively, the human sonic hedgehog (SHH), human interferon alpha-2 (IFN), or human cholesterol ester transferase (CETP) signal sequences (residues −23 to −1, −23 to −1, or −17 to −1, respectively), and the human IGHG1 Fc domain (residues 1 to 222) beginning at the eleventh amino acid encoded by the hinge exon, CPPCP (Ellison et al. (1982) Nuc. Acids Res. 10, 4071-4079). The three distinct pre-Fc polypeptides have lengths of 245, 245 and 239 residues, respectively. Part (ii) shows the mature Fc domain (length=222) having an N-terminal-S-terminus. The N-terminal cysteine residue is underlined. Part (iii) shows the mature Fc domain extended by native chemical ligation (length=226) to have an N-terminal-X-terminus. The N-terminal X amino acid (e.g., cysteine, selenocysteine) is underlined; it is followed by the sixth amino acid encoded by the hinge exon, XDKTHTCPPCP. (IGHG1, UniProtKB/Swiss-Prot entry P01857, Ig gamma-1 chain C region, *Homo sapiens*).

FIG. 36B: Amino acid sequences of various polypeptide synthetic intermediates of a human Fc symmetroadhesin precursor subunit with an N-terminal-X-terminus. Part (i) shows three distinct pre-Fc polypeptides comprising, alternatively, the human sonic hedgehog (SHH), human interferon alpha-2 (IFN), or human cholesterol ester transferase (CETP) signal sequences (residues −23 to −1, −23 to −1, or −17 to −1, respectively), and the human IGHG1 Fc domain (residues 1 to 219) beginning at the fourteenth amino acid encoded by the hinge exon, CP (Ellison et al. (1982) Nuc. Acids Res. 10, 4071-4079). The three distinct pre-Fc polypeptides have lengths of 242, 242 and 236 residues, respectively. Part (ii) shows the mature Fc domain (length=219) having an N-terminal-S-terminus. The N-terminal cysteine residue is underlined. Part shows the mature Fc domain extended by native chemical ligation (length=222) to have an N-terminal-X-terminus. The N-terminal X amino acid (e.g., cysteine, selenocysteine) is underlined; it is followed by the twelfth amino acid encoded by the hinge exon, XPPCP. (IGHG1, UniProtKB/Swiss-Prot entry P01857, Ig gamma-1 chain C region, *Homo sapiens*).

Figure 3:
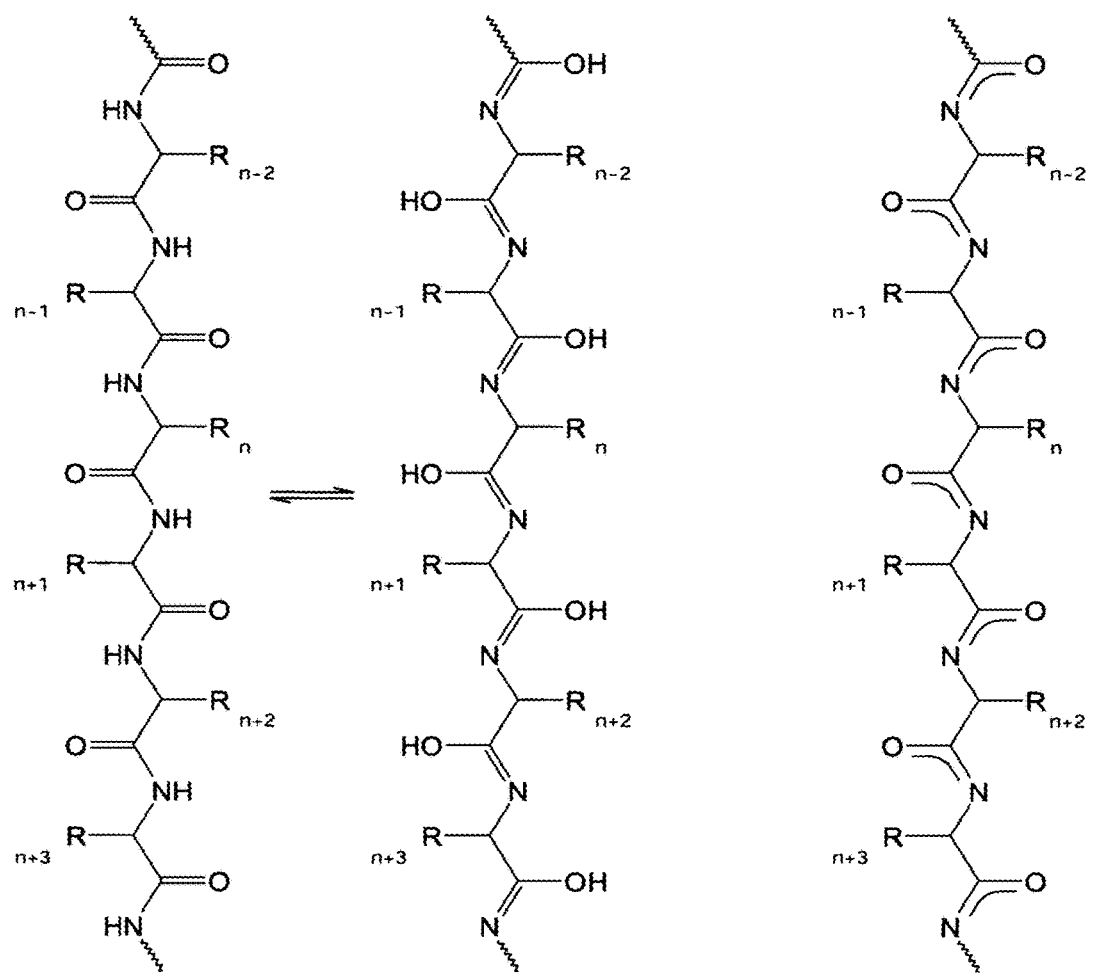
FIG. 3: General structure of a chimeric polypeptide consisting of a first stretch of consecutive amino acids joined at its C-terminus by a peptide bond to the N-terminus of a second stretch of consecutive amino acids. Chimeric polypeptides, like proteins found in nature, are continuous stretches of consecutive amino acids, each of which is joined to the preceding amino acid by a peptide bond. Like other proteins, chimeric polypeptides have limited conformational flexibility because the peptide bond by itself provides no more than two consecutive single bonds capable of dihedral rotation along the polypeptide chain. Amino acid residues in the figure are numbered as follows: The first stretch of consecutive amino acids has length=n residues, and numbering=1, 2, 3, . . . , (n−2), (n−1), n. The second stretch of consecutive amino acids has length=p residues, and numbering=1', 2', 3', . . . , (p−2), (p−1), p. The chimeric polypeptide has length=(n+p) residues, and numbering=1, 2, 3, . . . , (n−2), (n−1), n, (n+1), (n+2), (n+3), . . . , (n+p−2), (n+p−1), (n+p). The major and minor tautomeric forms and the resonance structure are shown on the left, center and right, respectively.
Figure 4A:
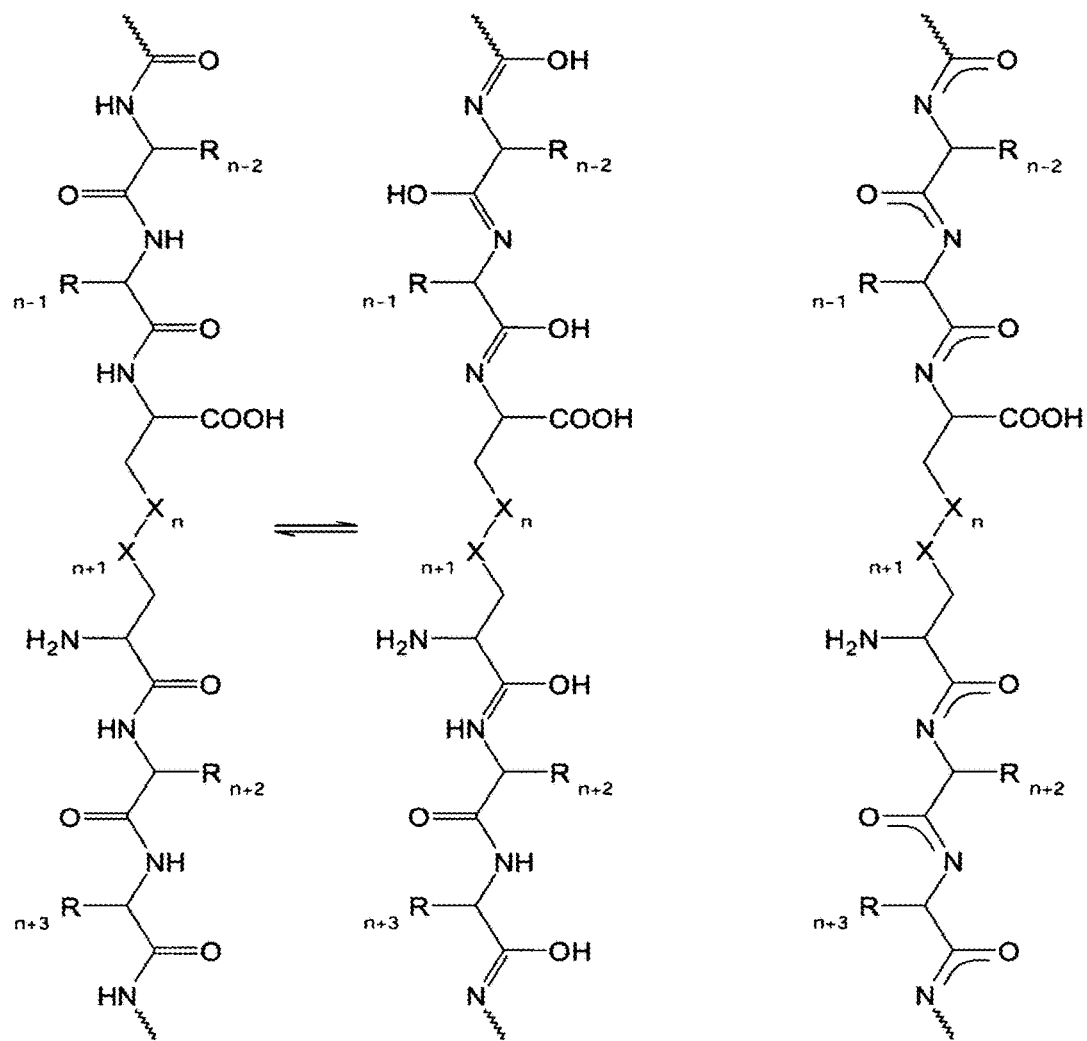
FIG. 4A: General structure of a "symmetroadhesin" with a head-to-tail configuration consisting of a first stretch of consecutive amino acids joined at its C-terminal-X-terminus by an —X—X— bond to the N-terminal-X-terminus of a second stretch of consecutive amino acids. The —X—X— bond is not a peptide bond. Non-limiting examples of the bonds envisaged here include any combination wherein each X is a S or a Se atom. The overall polarity of head-to-tail symmetroadhesins is N- to C-terminal. Symmetroadhesins, like proteins, are stretches of consecutive amino acids each of which is joined to the preceding amino acid, but differ from proteins by substituting one or more —X—X— bonds for peptide bonds. Symmetroadhesins have greater conformational flexibility than polypeptides because each —X—X— bond provides seven adjacent single bonds capable of dihedral rotation. Amino acid residues are numbered as follows: The first stretch of consecutive amino acids has length=n residues, and numbering=1, 2, 3, . . . , (n−2), (n−1), n. The second stretch of consecutive amino acids has length=p residues, and numbering=2', 3', . . . , (p−2), (p−1), p. The head-to-tail symmetroadhesin has length=(n+p) residues, and numbering=1, 2, 3, . . . , (n−2), (n−1), n, (n+1), (n+2), (n+3), . . . , (n+p−2), (n+p−1), (n+p). The major and minor tautomeric forms and the resonance structure are shown on the left, center and right, respectively.
Figure 4B:
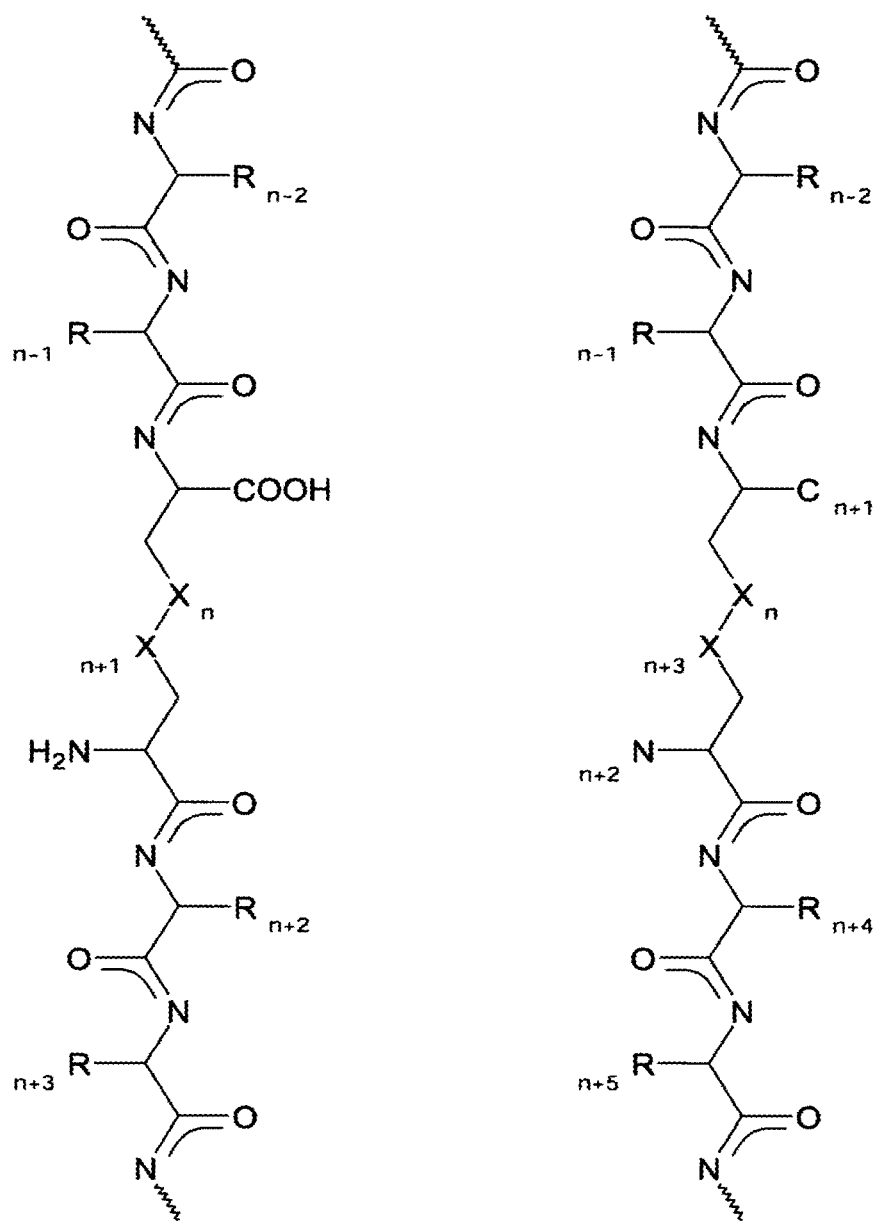
FIG. 4B: The symmetroadhesin of FIG. 4A (left) compared with a symmetroadhesin (right) consisting of a first stretch of consecutive amino acids joined at the X-terminus of its penultimate C-terminal residue by an —X—X— bond to the X-terminus of the penultimate N-terminal residue of a second stretch of consecutive amino acids. Resonance structures are shown for each.
Figure 4C:
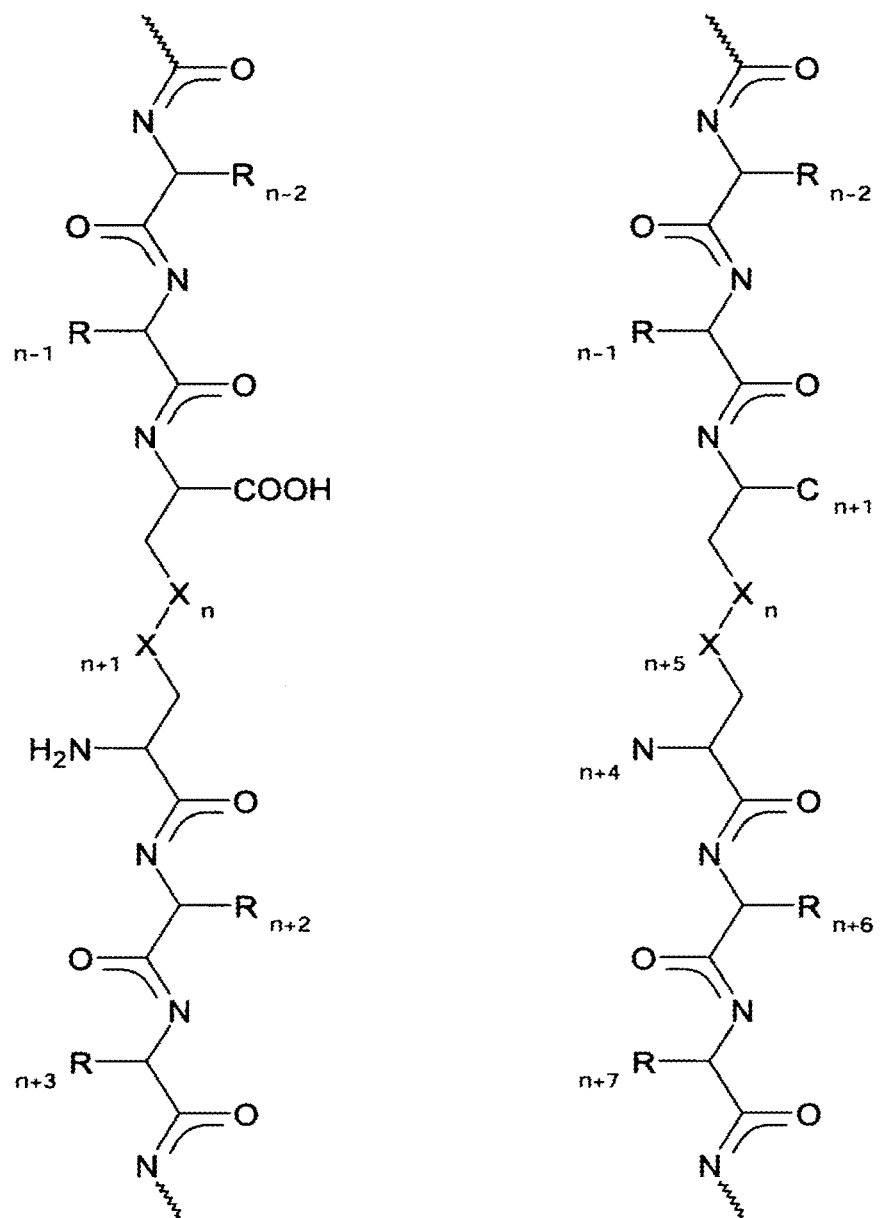
FIG. 4C: The symmetroadhesin of FIG. 4A (left) compared with a symmetroadhesin (right) consisting of a first stretch of consecutive amino acids joined at the X-terminus of its antepenultimate C-terminal residue by an —X—X— bond to the X-terminus of the antepenultimate N-terminal residue of a second stretch of consecutive amino acids. Resonance structures are shown for each.
Figure 4D:
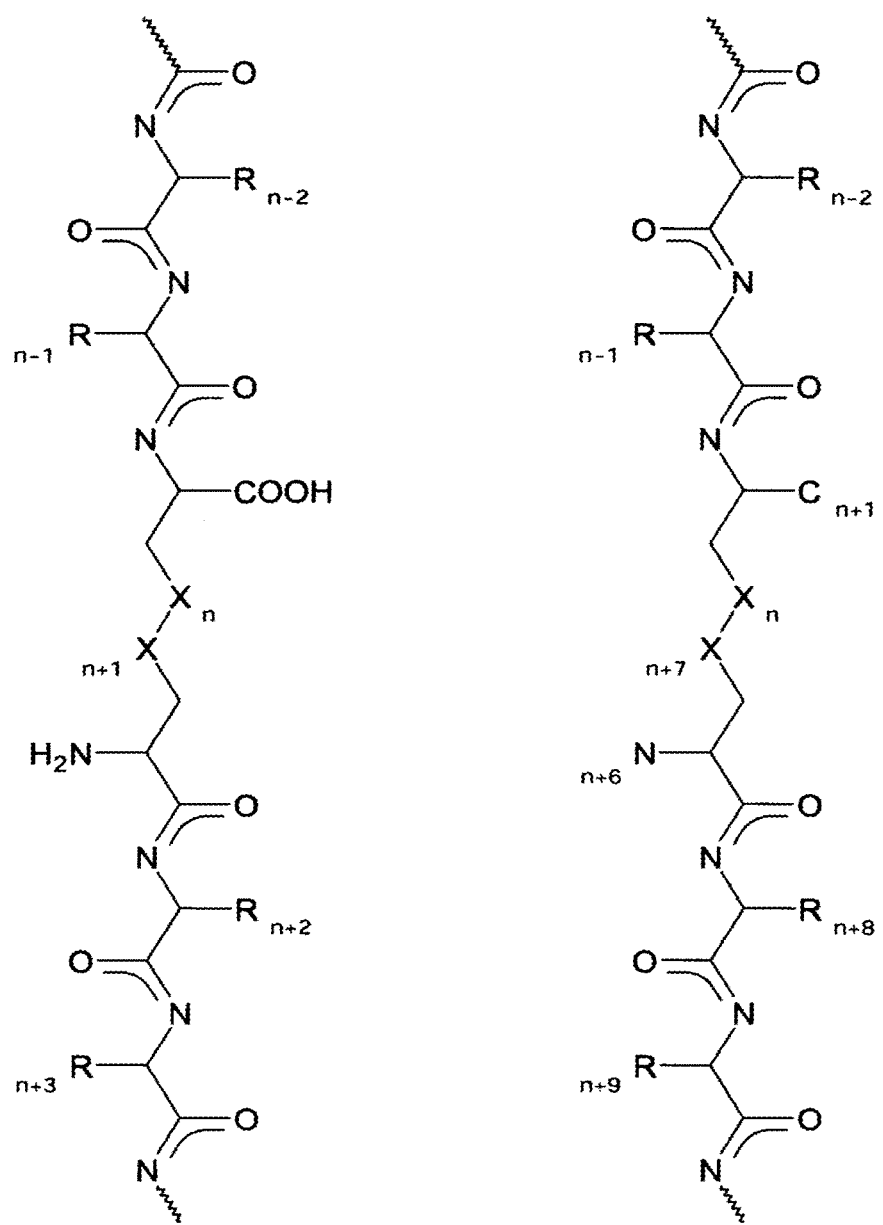
FIG. 4D: The symmetroadhesin of FIG. 4A (left) compared with a symmetroadhesin (right) consisting of a first stretch of consecutive amino acids joined at the X-terminus of its preantepenultimate C-terminal residue by an —X—X— bond to the X-terminus of the preantepenultimate N-terminal residue of a second stretch of consecutive amino acids. Resonance structures are shown for each.
Figure 5:
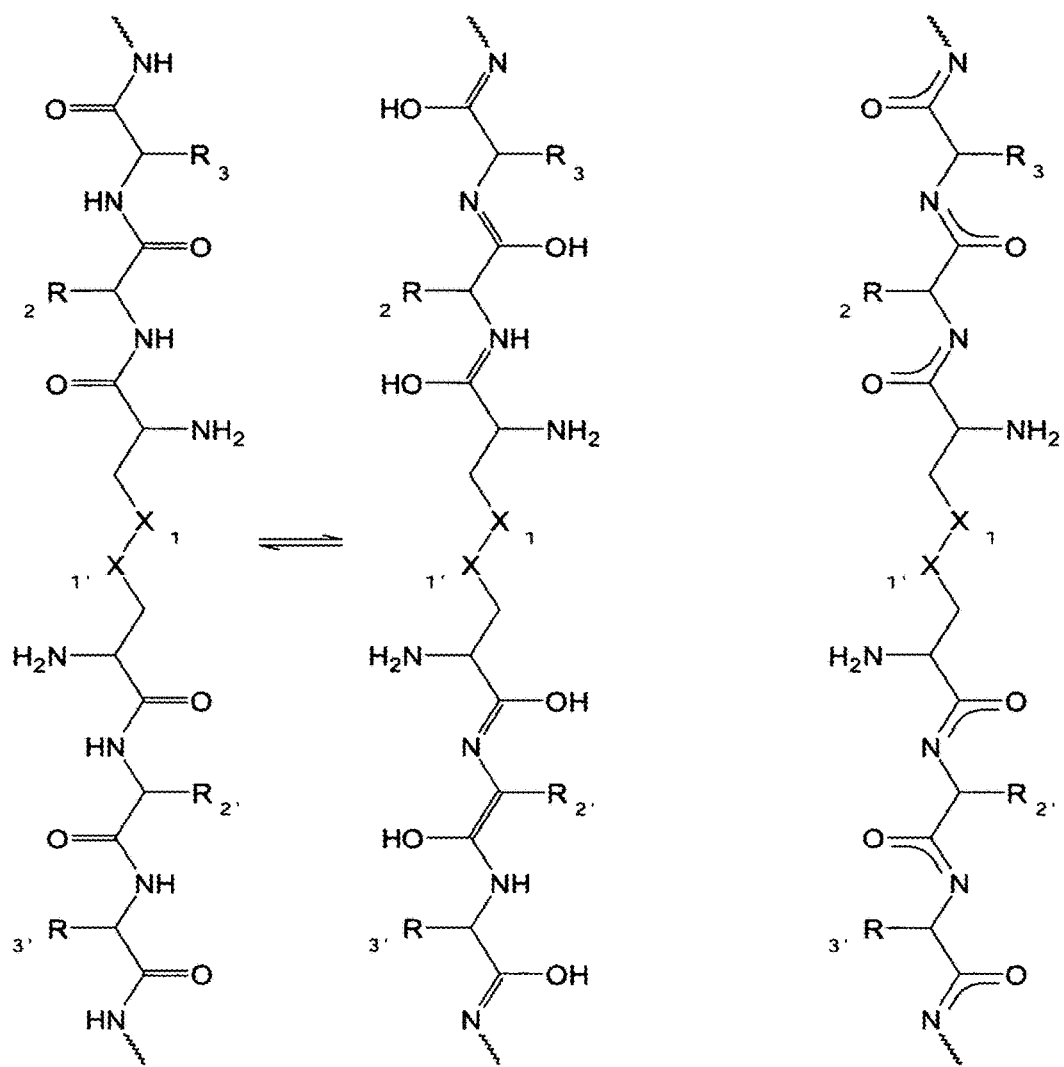
FIG. 5: General structure of a symmetroadhesin with a head-to-head configuration consisting of a first stretch of consecutive amino acids, joined at its N-terminal-X-terminus by an —X—X— bond to the N-terminal-X-terminus of a second stretch of consecutive amino acids. The overall polarity of head-to-head symmetroadhesins changes at the position of the —X—X— bond, going from C- to N-terminal to N- to C-terminal. Amino acid residues are numbered as follows: The first stretch of consecutive amino acids has length=n residues, and numbering=1, 2, 3, . . . , (n−2), (n−1), n. The second stretch of consecutive amino acids has length=p residues, and numbering=2', 3', . . . , (p−2), (p−1), p. The head-to-head symmetroadhesin has length=(n+p) residues, and numbering=n, (n−1), (n−2), . . . , 3, 2, 1, (inversion), 1', 2', 3', . . . , (p−2), (p−1), p. The major and minor tautomeric forms and the resonance structure are shown on the left, center and right, respectively.
Figure 6:
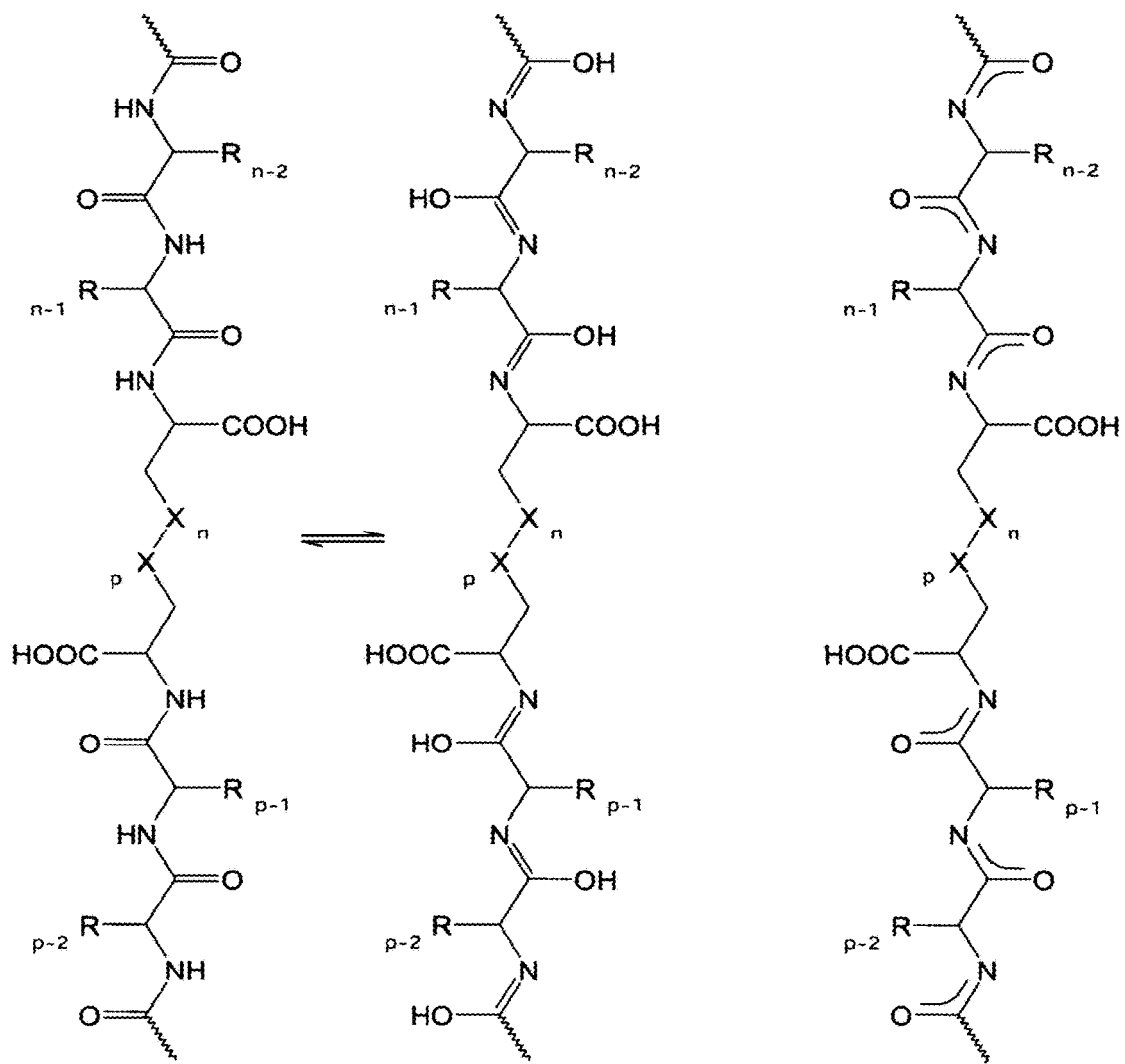
FIG. 6: General structure of a symmetroadhesin with a tail-to-tail configuration consisting of a first stretch of consecutive amino acids joined at its C-terminal-X-terminus by an —X—X— bond to the C-terminal-X-terminus of a second stretch of consecutive amino acids. The overall polarity of tail-to-tail symmetroadhesins changes at the position of the —X—X— bond, going from N- to C-terminal to C- to N-terminal. Amino acid residues are numbered as follows: The first stretch of consecutive amino acids has length=n residues, and numbering=1, 2, 3, . . . , (n−2), (n−1), n. The second stretch of consecutive amino acids has length=p residues, and numbering=2', 3', . . . , (p−2), (p−1), p. The tail-to-tail symmetroadhesin has length=n+p residues, and numbering=1, 2, 3, . . . , (n−2), (n−1), n, (inversion), p, (p−1), (p−2), . . . , 3', 2', 1'. The major and minor tautomeric forms and the resonance structure are shown on the left, center and right, respectively.
Figure 7:
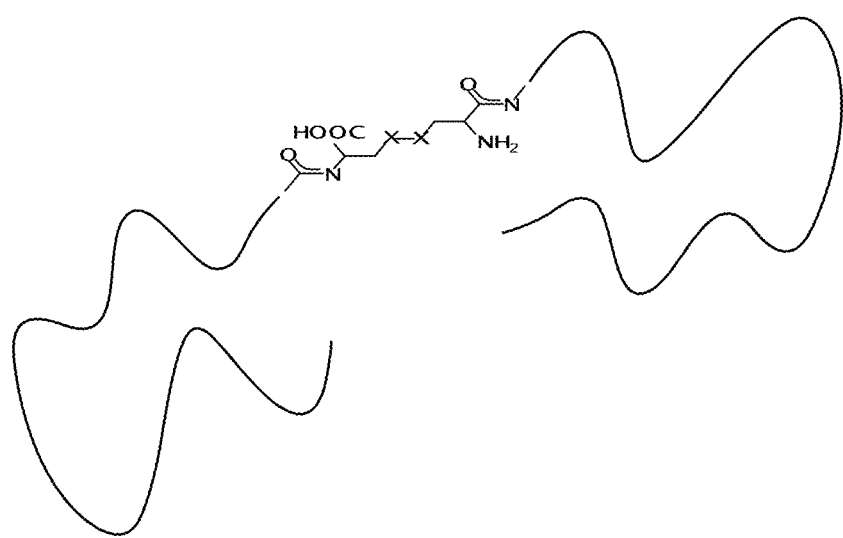
FIG. 7: A schematic representation of a head-to-tail hemi-symmetroadhesin showing the all-trans conformation. All of the seven consecutive single bonds joining the C-terminal-X-terminus with the N-terminal-X-terminus are trans (N—C—C—X—X—C—C—C). The two binding domains are pointed away from one another in this conformation; a rotation of 180 degrees around any one of the seven consecutive single bonds will point the two binding domains towards one another. Hemi-symmetroadhesins with the head-to-tail configuration are asymmetric molecules regardless of conformation (compare FIGS. 7 and 8); however, two or more head-to-tail hemi-symmetroadhesins can together form a symmetric molecule.
Figure 8:
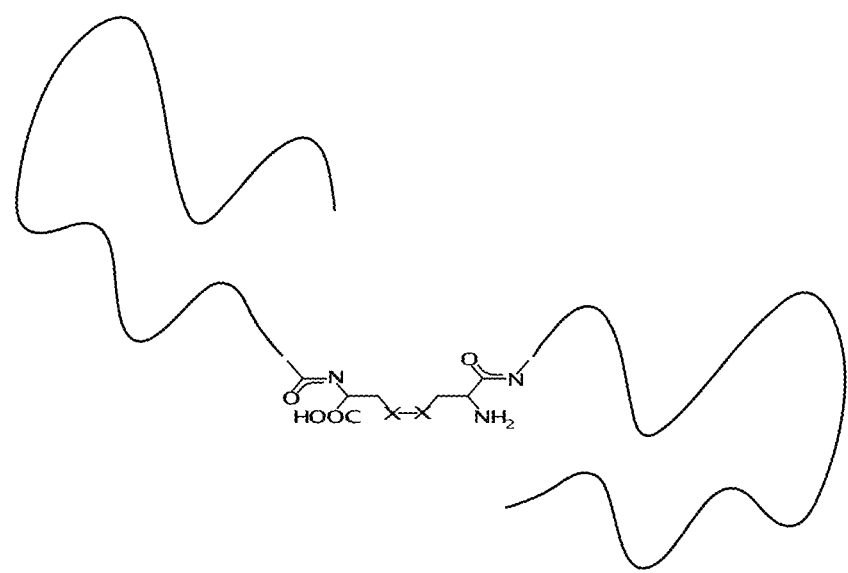
FIG. 8: A schematic representation of a head-to-tail hemi-symmetroadhesin showing the X-cis-X conformation. All but one of seven consecutive single bonds joining the C-terminal-X-terminus with the N-terminal-X-terminus are trans (N—C—C—X-cis-X—C—C—C). The two binding domains are pointed towards one another in this conformation; further rotations of 180 degrees around any one of the seven consecutive single bonds will point the two binding domains away from one another. Hemi-symmetroadhesins with the head-to-tail configuration are asymmetric molecules regardless of conformation (compare FIGS. 7 and 8); however, two or more head-to-tail hemi-symmetroadhesins can together form a symmetric molecule.
Figure 9:
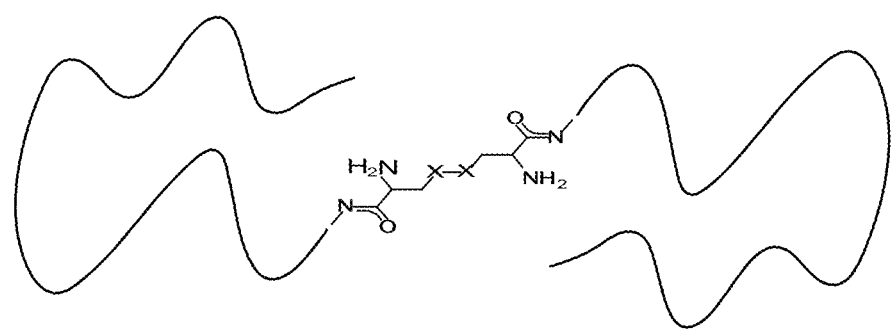
FIG. 9: A schematic representation of a head-to-head hemi-symmetroadhesin showing the all-trans conformation. All of the seven consecutive single bonds joining the $1^{st}$ N-terminal-X-terminus and $2^{nd}$ N-terminal-X-terminus are trans (C—C—C—X—X—C—C—C). The two binding domains are pointed away from one another in this conformation; a rotation of 180 degrees around any one of the seven consecutive single bonds will point the two binding domains towards one another. Hemi-symmetroadhesins with the head-to-head configuration are symmetric molecules in only two of their possible conformations: the all-trans and the X-cis-X (compare FIGS. 9 and 10); however, two or more head-to-head hemi-symmetroadhesins subunits can form a molecule that has an unlimited number of symmetric conformations.
Figure 10:
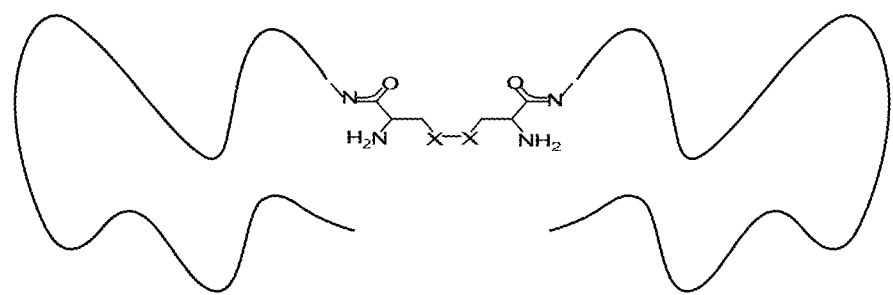
FIG. 10: A schematic representation of a head-to-head hemi-symmetroadhesin showing the X-cis-X conformation. All but one of the seven consecutive single bonds joining the $1^{st}$ N-terminal-X-terminus and $2^{nd}$ N-terminal-X-terminus are trans (C—C—C—X-cis-X—C—C—C). The two binding domains are pointed towards one another in this conformation; further rotations of 180 degrees around any one of the seven consecutive single bonds will point the two binding domains away from one another. Hemi-symmetroadhesins with the head-to-head configuration are symmetric molecules in only two of their possible conformations: the all-trans and the X-cis-X (compare FIGS. 9 and 10); however, two or more head-to-head hemi-symmetroadhesins subunits can form a molecule that has an unlimited number of symmetric conformations.
Figure 11:
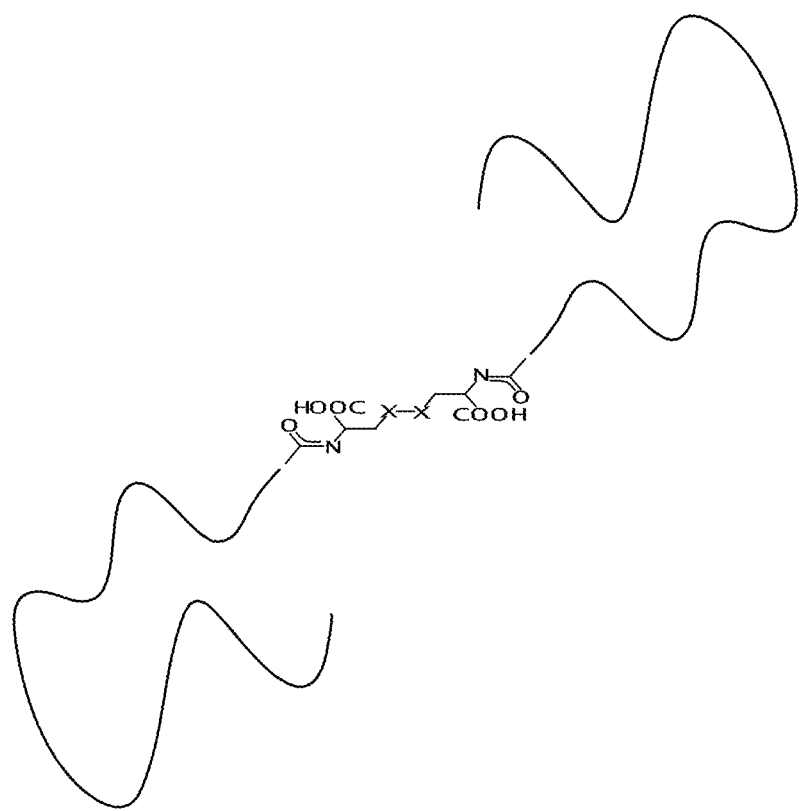
FIG. 11: A schematic representation of a tail-to-tail hemi-symmetroadhesin showing the all-trans conformation. All of the seven consecutive single bonds joining the $1^{st}$ C-terminal-X-terminus and $2^{nd}$ C-terminal-X-terminus are trans (N—C—C—X—X—C—C—N). The two binding domains are pointed away from one another in this conformation; a rotation of 180 degrees around any one of the seven consecutive single bonds will point the two binding domains towards one another. Hemi-symmetroadhesins with the tail-to-tail configuration are symmetric molecules in only two of their possible conformations: the all-trans and the X-cis-X (compare FIGS. 11 and 12); however, two or more tail-to-tail hemi-symmetroadhesins subunits can form a molecule that has an unlimited number of symmetric conformations.
Figure 12:
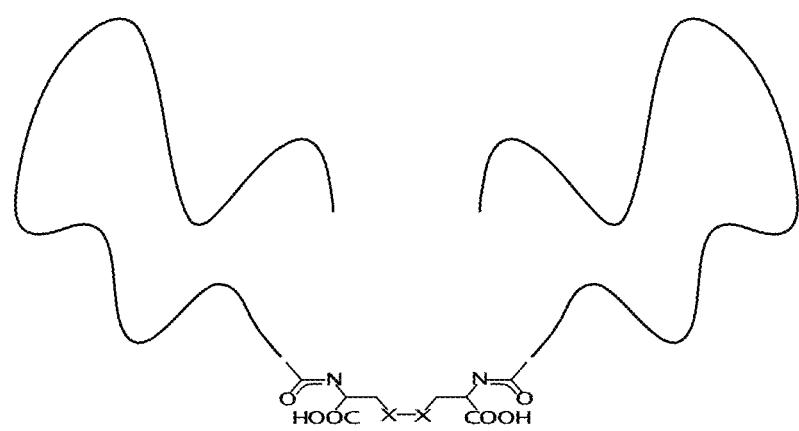
FIG. 12: A schematic representation of a tail-to-tail hemi-symmetroadhesin showing the X-cis-X conformation. All but one of the seven consecutive single bonds joining the $1^{st}$ C-terminal-X-terminus and $2^{nd}$ C-terminal-X-terminus are trans (N—C—C—X-cis-X—C—C—N). The two binding domains are pointed towards one another in this conformation; further rotations of 180 degrees around any one of the seven consecutive single bonds will point the two binding domains away from one another. Hemi-symmetroadhesins with the tail-to-tail configuration are symmetric molecules in only two of their possible conformations: the all-trans and the X-cis-X (compare FIGS. 9 and 10); however, two or more tail-to-tail hemi-symmetroadhesins subunits can form a molecule that has an unlimited number of symmetric conformations.
Figure 13:
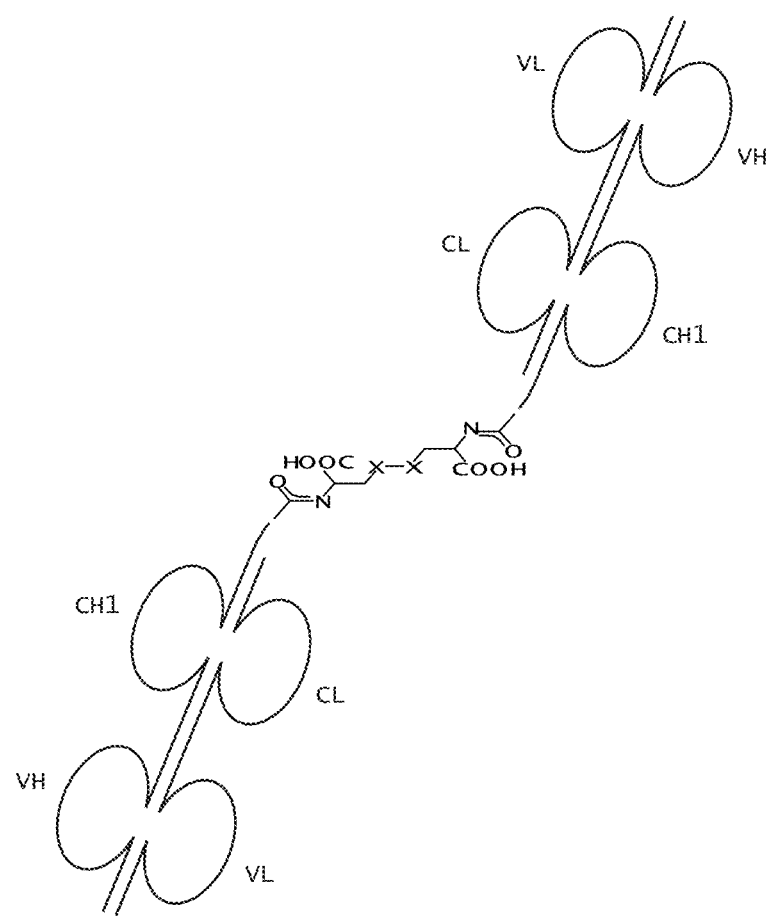
FIG. 13: A schematic representation of a tail-to-tail hemi-symmetroadhesin consisting of two immunoglobulin Fab binding domains. The all-trans conformation is shown here. All of the seven consecutive single bonds joining the $1^{st}$ C-terminal-X-terminus and $2^{nd}$ C-terminal-X-terminus are trans (N—C—C—X—X—C—C—N). The two Fab binding domains are pointed away from one another in this conformation; a rotation of 180 degrees around any one of the seven consecutive single bonds will point the Fab binding domains towards one another (compare FIGS. 13 and 14). The heavy chain regions are joined together by the X—X bond; the light chain regions are joined to the heavy chain regions by internal disulfide bonds. Abbreviations: VL, light chain variable region; CL, light chain constant region; VH, heavy chain variable region; CH1, heavy chain constant region 1.
Figure 14:
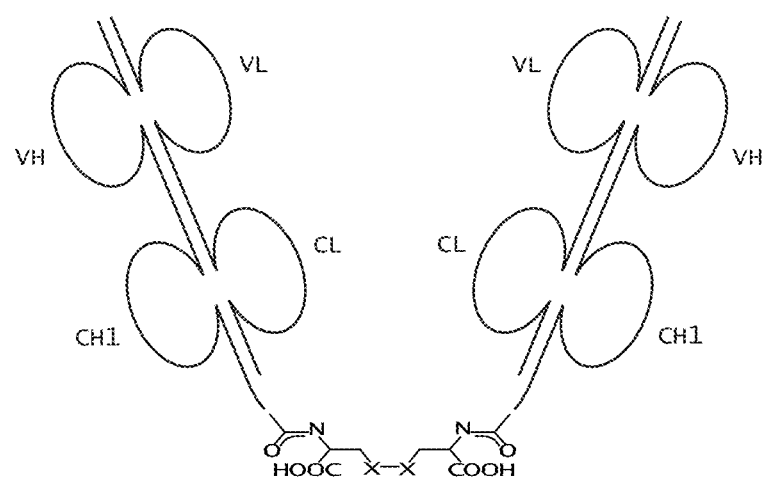
FIG. 14: A schematic representation of a tail-to-tail hemi-symmetroadhesin consisting of two immunoglobulin Fab binding domains. The X-cis-X conformation is shown here. All but one of seven consecutive single bonds joining the $1^{st}$ C-terminal-X-terminus and $2^{nd}$ C-terminal-X-terminus are trans (N—C—C—X-cis-X—C—C—N). The two Fab binding domains are pointed towards one another in this conformation; further rotation of 180 degrees around any one of the seven consecutive single bonds will point the Fab binding domains away from one another (compare FIGS. 13 and 14). The heavy chain regions are joined together by the X—X bond; the light chain regions are joined to the heavy chain regions by internal disulfide bonds. Abbreviations: VL, light chain variable region; CL, light chain constant region; VH, heavy chain variable region; CH1, heavy chain constant region 1.
Figure 15:
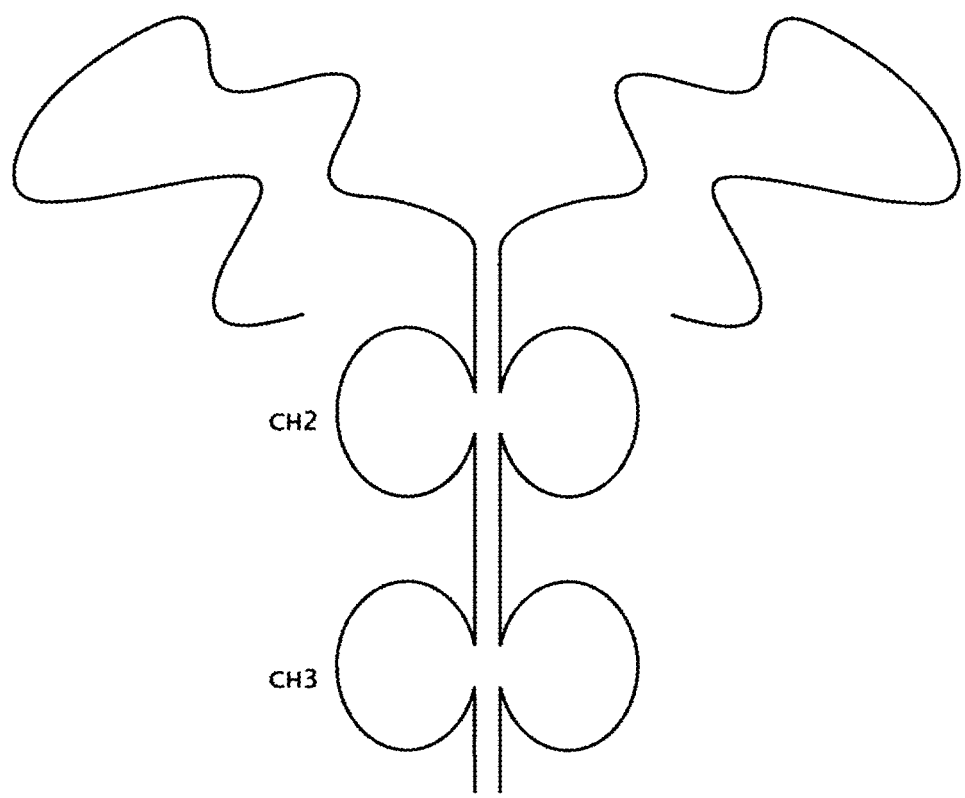
FIG. 15: Schematic representation of the immunoadhesin molecule (Capon et al. (1989) Nature 337, 525-530). Immunoadhesins are chimeric polypeptides that form disulfide-linked dimers. Each chimeric polypeptide consists of a binding domain joined at its C-terminus by a peptide bond to the N-terminus of an immunoglobulin Fc domain. Although immunoadhesins are structurally symmetric, they do not generally bind cooperatively to dimeric or multimeric target molecules. Abbreviations: CH2, heavy chain constant region 2; CH3, heavy chain constant region 3.
Figure 16:
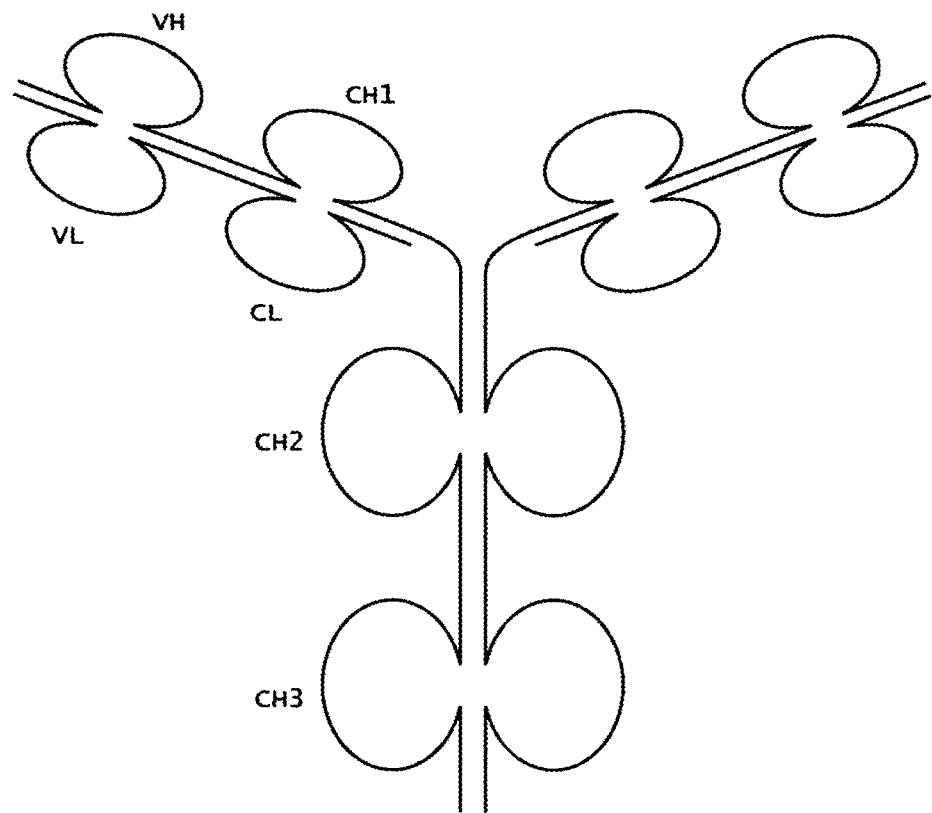
FIG. 16: Schematic representation of the immunoglobulin (antibody) molecule. Immunoglobulins are heterotetramers consisting of two heavy chains and two light chains. Although immunoglobulins are structurally symmetric, they do not generally bind cooperatively to dimeric or multimeric target molecules. Abbreviations: VL, light chain variable region; CL, light chain constant region; VH, heavy chain variable region; CH1, heavy chain constant region 1; CH2, heavy chain constant region 2; CH3, heavy chain constant region 3.
Figure 17:
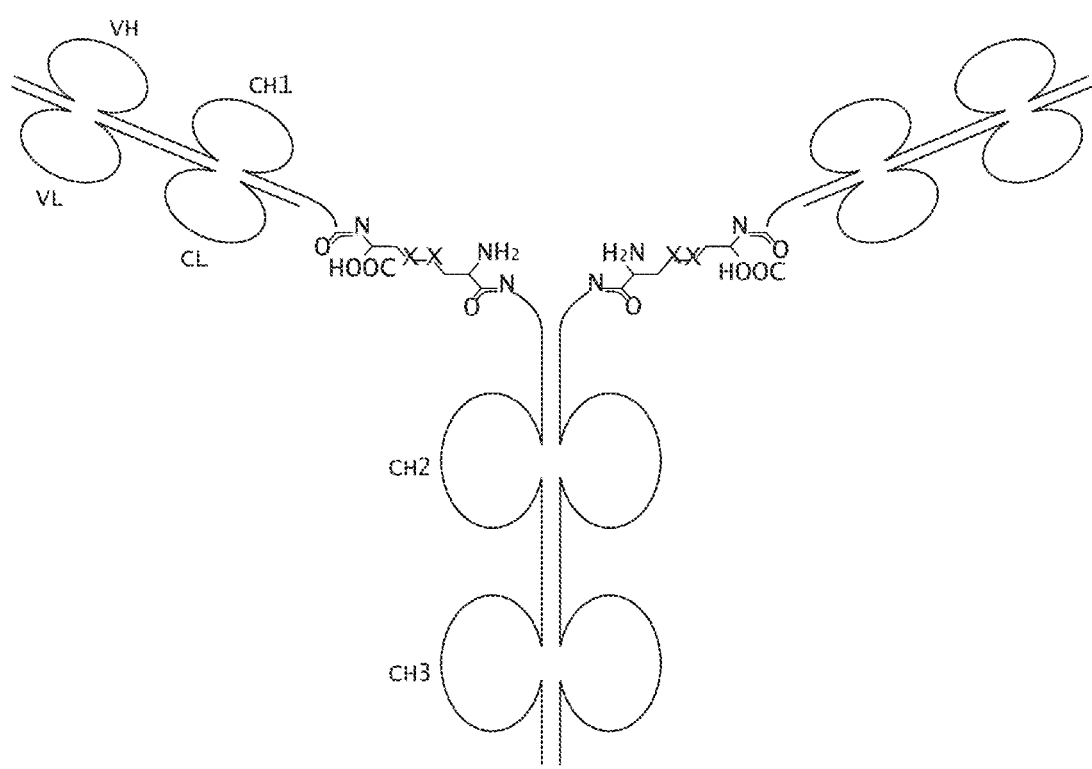
FIG. 17: A schematic representation of a head-to-tail immunosymmetroadhesin showing the all-trans conformation. Head-to-tail immunosymmetroadhesins are head-to-tail hemi-symmetroadhesins that form disulfide-linked dimers. Each hemi-symmetroadhesin consists of an immunoglobulin Fab binding domain having a C-terminal-X-terminus joined by an —X—X— bond to a immunoglobulin Fc subunit having an N-terminal-X-terminus. The dimer contains two functional Fab binding domains and one functional Fc binding domain. The seven consecutive single bonds which join each Fab domain to an Fc subunit are all trans (N—C—C—X—X—C—C—C). Symmetric rotations of 180 degrees around the first (N—C), third (C—X), fifth (X—C), or seventh (C—C) pairs of consecutive single bonds will move the two Fab domains in a first general direction (compare FIGS. 17 and 18). Symmetric rotations of 180 degrees around the second (C—C), fourth (X—X), or sixth (C—C) single bond pairs will move the two Fab domains in a second general direction (compare FIGS. 17 and 19).
Figure 18:
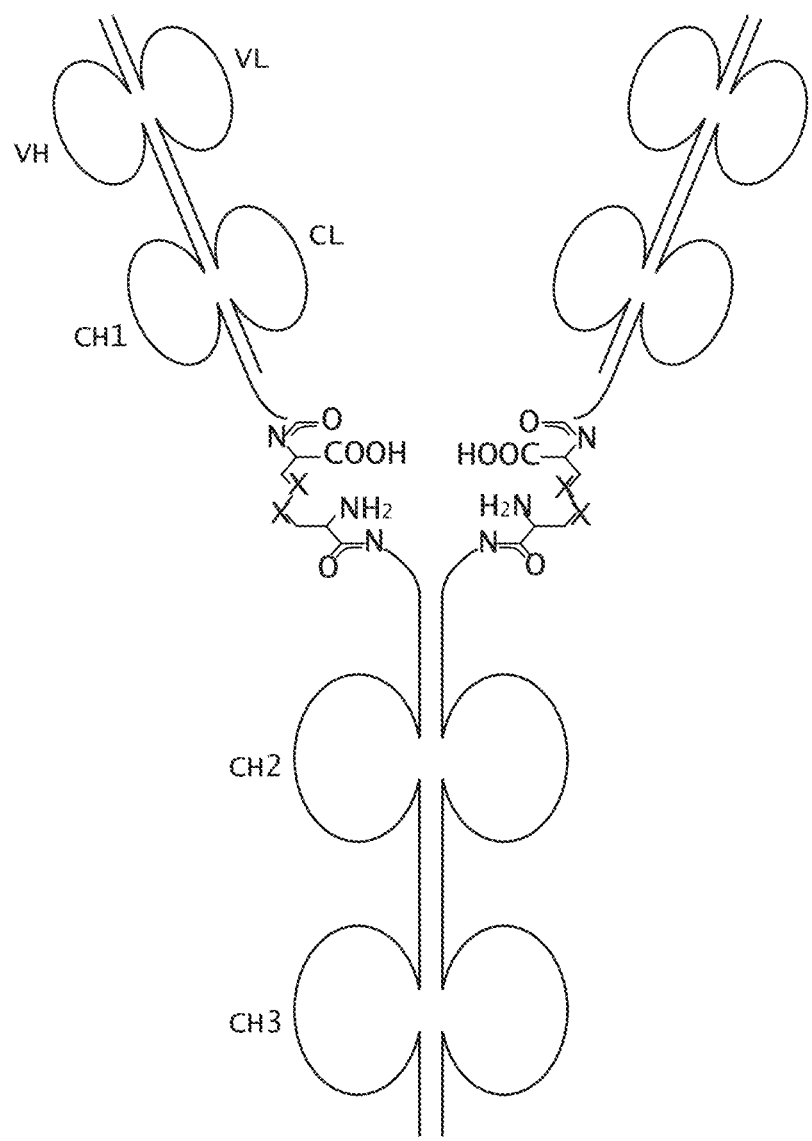
FIG. 18: A schematic representation of a head-to-tail immunosymmetroadhesin showing the X-cis-C conformation. The X-cis-C conformation is obtained from the all-trans conformation by the symmetric rotation of the fifth pair of seven consecutive single bonds (N—C—C—X—X-cis-C—C—C) (compare FIGS. 17 and 18). Other conformations that are similar to the X-cis-C conformation shown here are obtained from the all-trans conformation following the symmetric rotation of the first (N-cis-C—C—X—X—C—C—C), the third (N—C—C-cis-X—X—C—C—C), or the seventh pairs (N—C—C—X—X—C—C-cis-C) of consecutive single bonds.
Figure 19:
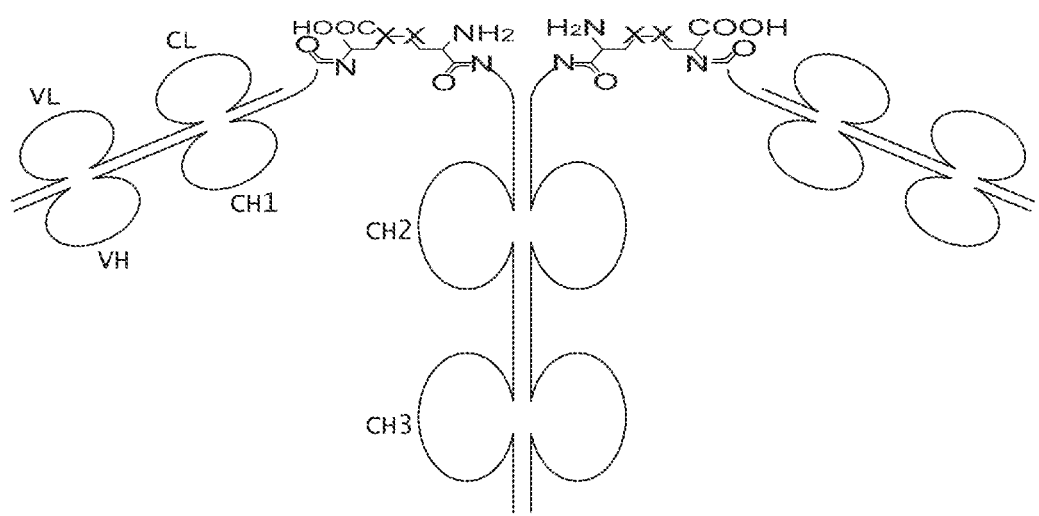
FIG. 19: A schematic representation of a head-to-tail immunosymmetroadhesin showing the X-cis-X conformation. The X-cis-X conformation is obtained from the all-trans conformation by the symmetric rotation of the fourth pair of seven consecutive single bonds (N—C—C—X-cis-X—C—C—C) (compare FIGS. 17 and 19). Other conformations that are similar to the X-cis-X conformation shown here are obtained from the all-trans conformation following the symmetric rotation of the second (N—C-cis-C—X—X—C—C—C), or the sixth pairs (N—C—C—X—X—C-cis-C—C) of consecutive single bonds.
Figure 20:
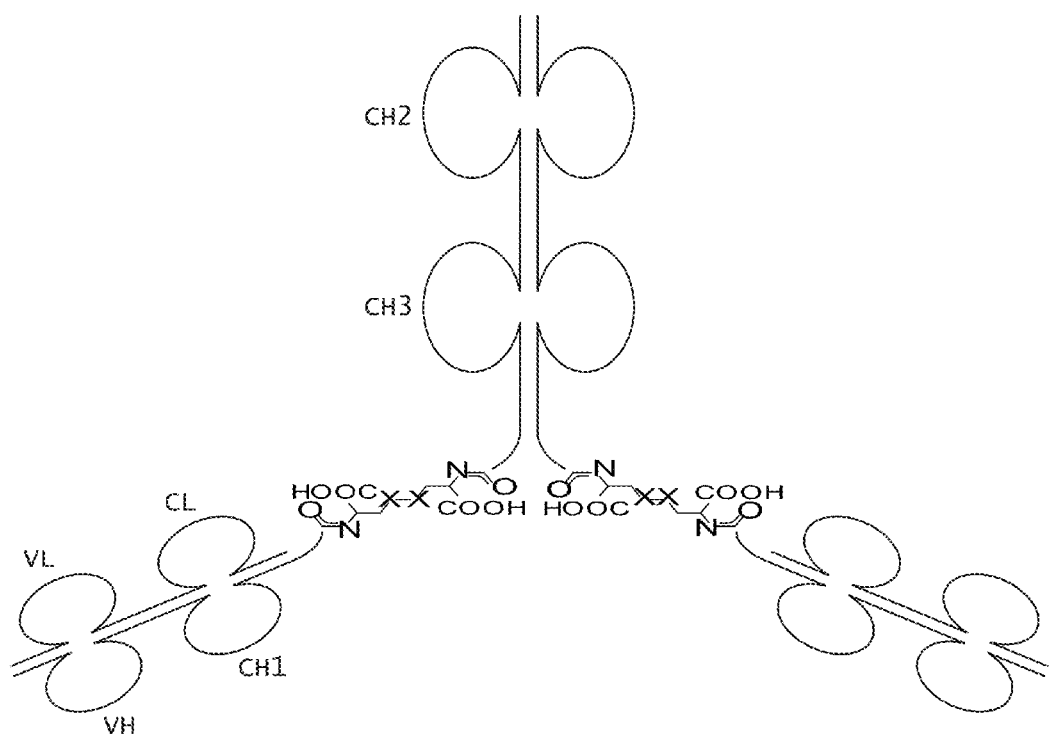
FIG. 20: A schematic representation of a tail-to-tail immunosymmetroadhesin showing the all-trans conformation. Tail-to-tail immunosymmetroadhesins are tail-to-tail hemi-symmetroadhesins that form disulfide-linked dimers. Each hemi-symmetroadhesin consists of an immunoglobulin Fab binding domain having a C-terminal-X-terminus joined by an X—X bond to an immunoglobulin Fc subunit having a C-terminal-X-terminus. The dimer contains two functional Fab binding domains and one functional Fc binding domain. The seven consecutive single bonds which join each Fab domain to an Fc subunit are all trans (N—C—C—X—X—C—C—N). Symmetric rotations of 180 degrees around the first (N—C), third (C—X), fifth (X—C), or seventh (C—N) pairs of consecutive single bonds will move the two Fab domains in a first general direction (compare FIGS. 20 and 21). Symmetric rotations of 180 degrees around the second (C—C), fourth (X—X), or sixth (C—C) single bond pairs will move the two Fab domains in a second general direction (compare FIGS. 20 and 22).
Figure 21:
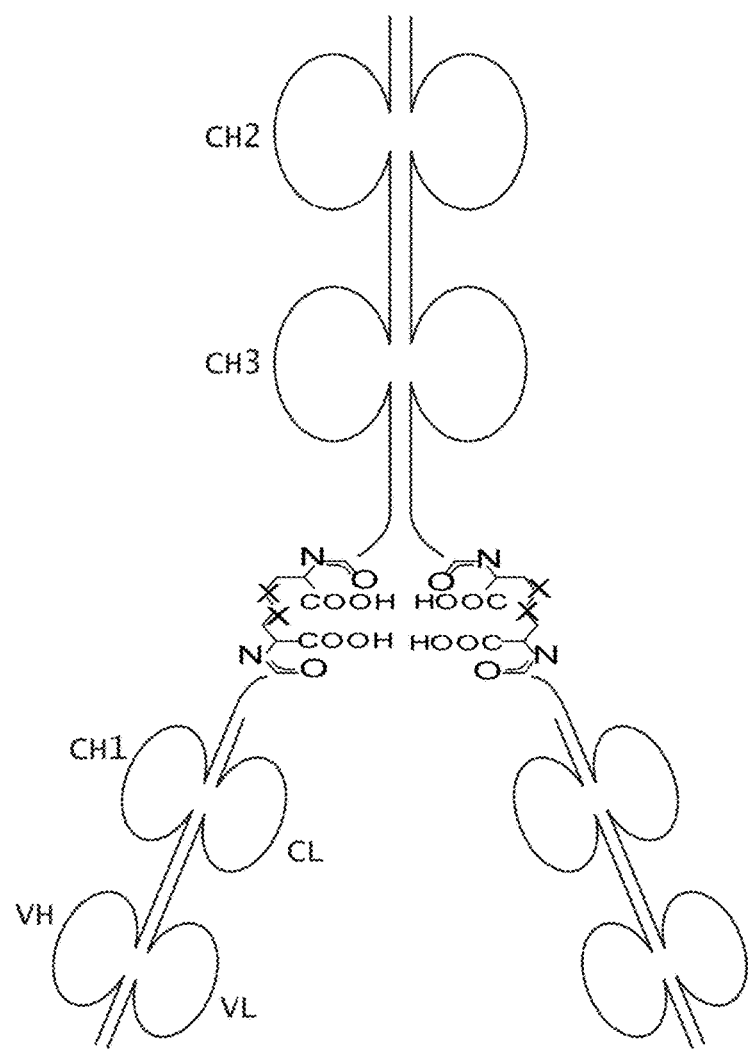
FIG. 21: A schematic representation of a tail-to-tail immunosymmetroadhesin showing the X-cis-C conformation. The X-cis-C conformation is obtained from the all-trans conformation by the symmetric rotation of the fifth pair of seven consecutive single bonds (N—C—C—X—X-cis-C—C—N) (compare FIGS. 20 and 21). Other conformations that are similar to the X-cis-C conformation shown here are obtained from the all-trans conformation following the symmetric rotation of the first (N-cis-C—C—X—X—C—C—N), the third (N—C—C-cis-X—X—C—C—N), or the seventh pairs (N—C—C—X—X—C—C-cis-N) of consecutive single bonds.
Figure 22:
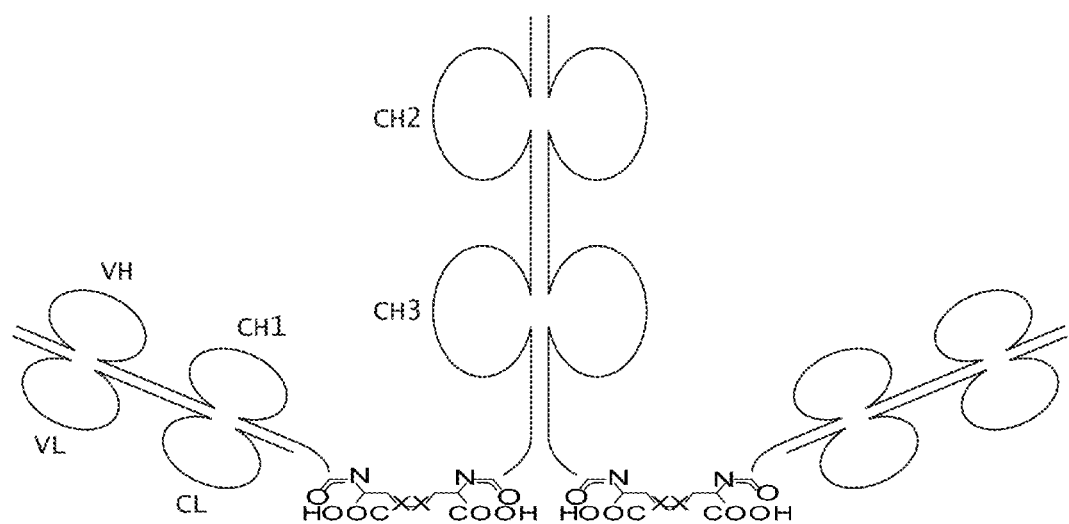
FIG. 22: A schematic representation of a tail-to-tail immunosymmetroadhesin showing the X-cis-X conformation. The X-cis-X conformation is obtained from the all-trans conformation by the symmetric rotation of the fourth pair of seven consecutive single bonds (N—C—C—X-cis-X—C—C—N) (compare FIGS. 20 and 22). Other conformations that are similar to the X-cis-X conformation shown here are obtained from the all-trans conformation following the symmetric rotation of the second (N—C-cis-C—X—X—C—C—N), or the sixth pairs (N—C—C—X—X—C-cis-C—N) of consecutive single bonds.
Figure 23:
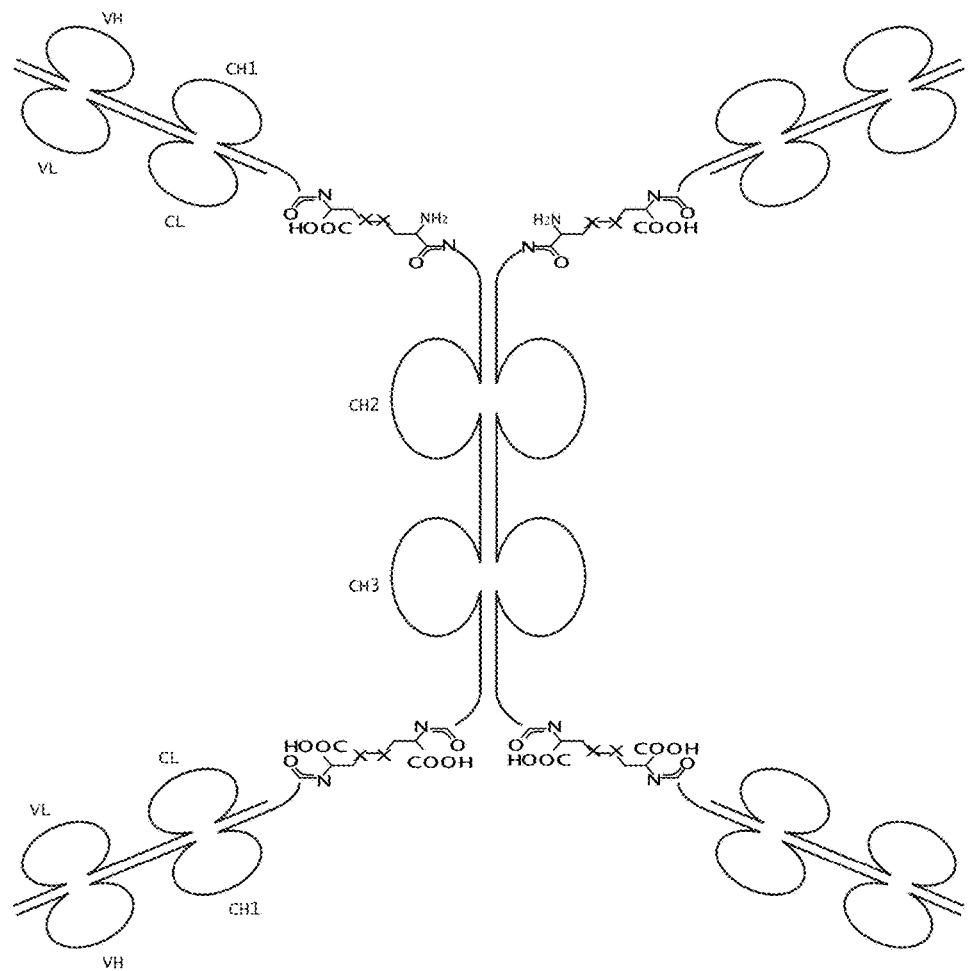
FIG. 23: Schematic representation of bi-symmetroadhesin with four Fab binding domains, showing the all-trans conformation. The molecule is a dimer of two hemi-symmetroadhesins each consisting of three stretches of consecutive amino acids. The bi-symmetroadhesin shown here is a head-to-tail, tail-to-tail hemi-symmetroadhesin that forms disulfide-linked dimers. Each hemi-symmetroadhesin consists of two immunoglobulin Fab domains having a C-terminal-X-terminus that is joined by an —X—X— bond to a immunoglobulin Fc subunit; the first Fab domain is joined to the Fc N-terminal-X-terminus, and the second Fab is joined to the Fc C-terminal-X-terminus. The dimer has four functional Fab binding domains, and one functional Fc binding domain. The seven consecutive single bonds which join all four Fab domains to an Fc subunit are all trans (N—C—C—X—X—C—C—C/N). Symmetric rotations of 180 degrees around the first (N—C), third (C—X), fifth (X—C), or seventh (C—C/N) pairs of consecutive single bonds will move the four Fab domains in a first general direction (compare FIGS. 23 and 24). Symmetric rotations of 180 degrees around the second (C—C), fourth (X—X), or sixth (C—C) single bond pairs will move the four Fab domains in a second general direction (compare FIGS. 23 and 25).
Figure 24:
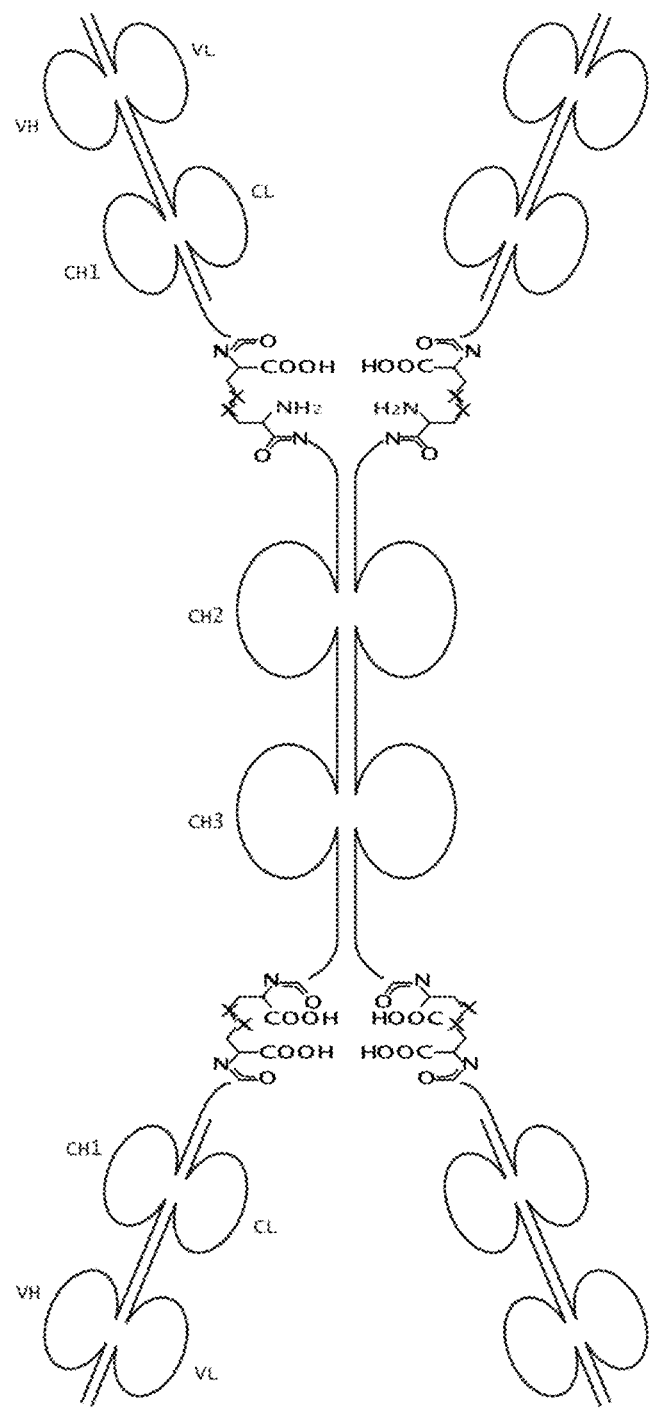
FIG. 24: Schematic representation of the X-cis-C conformation of a bi-immunosymmetroadhesin consisting of four Fab binding domains and one Fc domain. The molecule is a dimer of two hemi-symmetroadhesins each consisting of three stretches of consecutive amino acids.
Figure 25:
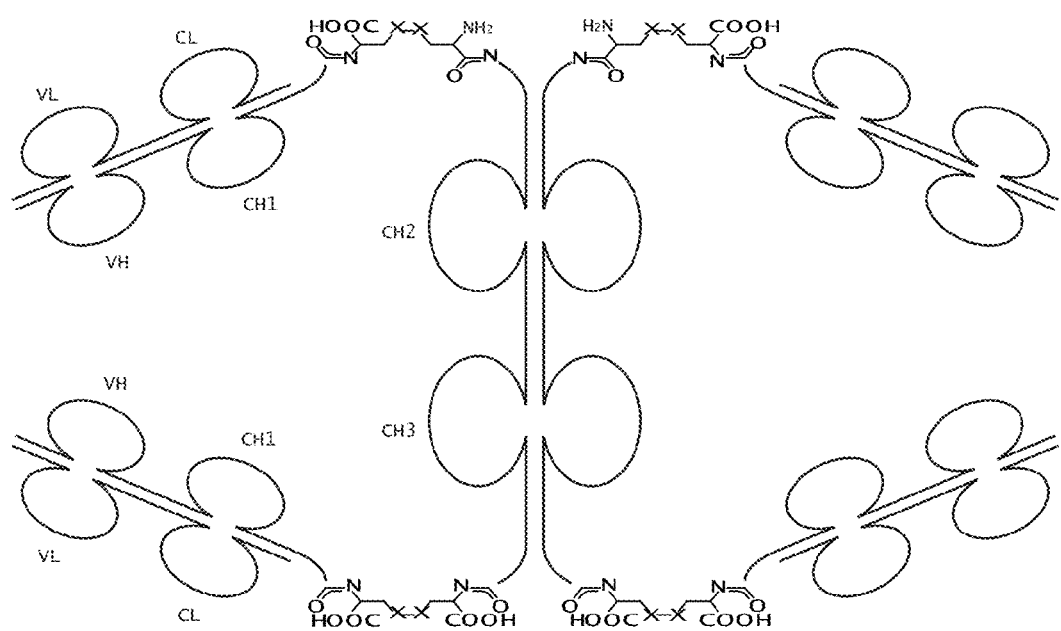
FIG. 25: Schematic representation of the X-cis-X conformation of a bi-immunosymmetroadhesin consisting of four Fab binding domains and one Fc domain. The molecule is a dimer of two hemi-symmetroadhesins each consisting of three stretches of consecutive amino acids.
Figure 26:
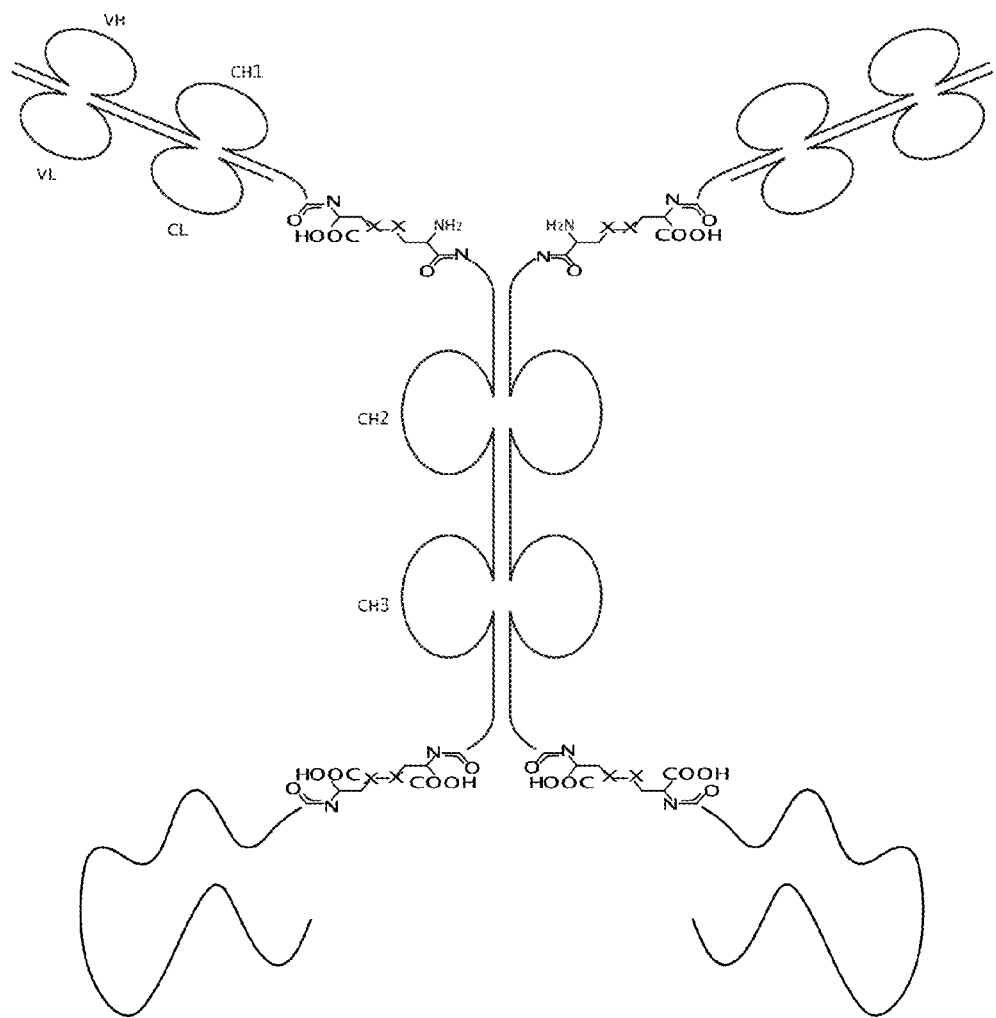
FIG. 26: Schematic representation of the all-trans conformation of a bi-immunosymmetroadhesin consisting of two Fab binding domains, one Fc domain, and two non-Fab binding domains. The molecule is a dimer of two hemi-symmetroadhesins each consisting of three stretches of consecutive amino acids. The bi-symmetroadhesin shown here is a head-to-tail, tail-to-tail hemi-symmetroadhesin that forms disulfide-linked dimers. Each hemi-symmetroadhesin consists of one immunoglobulin Fab domain having a C-terminal-X-terminus that is joined by an —X—X-bond to the N-terminal-X-terminus of an immunoglobulin Fc subunit, and one non-immunoglobulin binding domain having a C-terminal-X-terminus that is joined by an —X—X— bond to the C-terminal-X-terminus of an immunoglobulin Fc subunit. The dimer has two functional Fab binding domains, two functional non-immunoglobulin binding domains, and one functional Fc binding domain. The seven consecutive single bonds which join all four binding domain to an Fc subunit are all trans (N—C—C—X—X—C—C—C/N). Symmetric rotations of 180 degrees around the first (N—C), third (C—X), fifth (X—C), or seventh (C—C/N) pairs of consecutive single bonds will move the four binding domains in a first general direction (compare FIGS. 26 and 27). Symmetric rotations of 180 degrees around the second (C—C), fourth (X—X), or sixth (C—C) single bond pairs will move the four binding domains in a second general direction (compare FIGS. 26 and 28).
Figure 27:
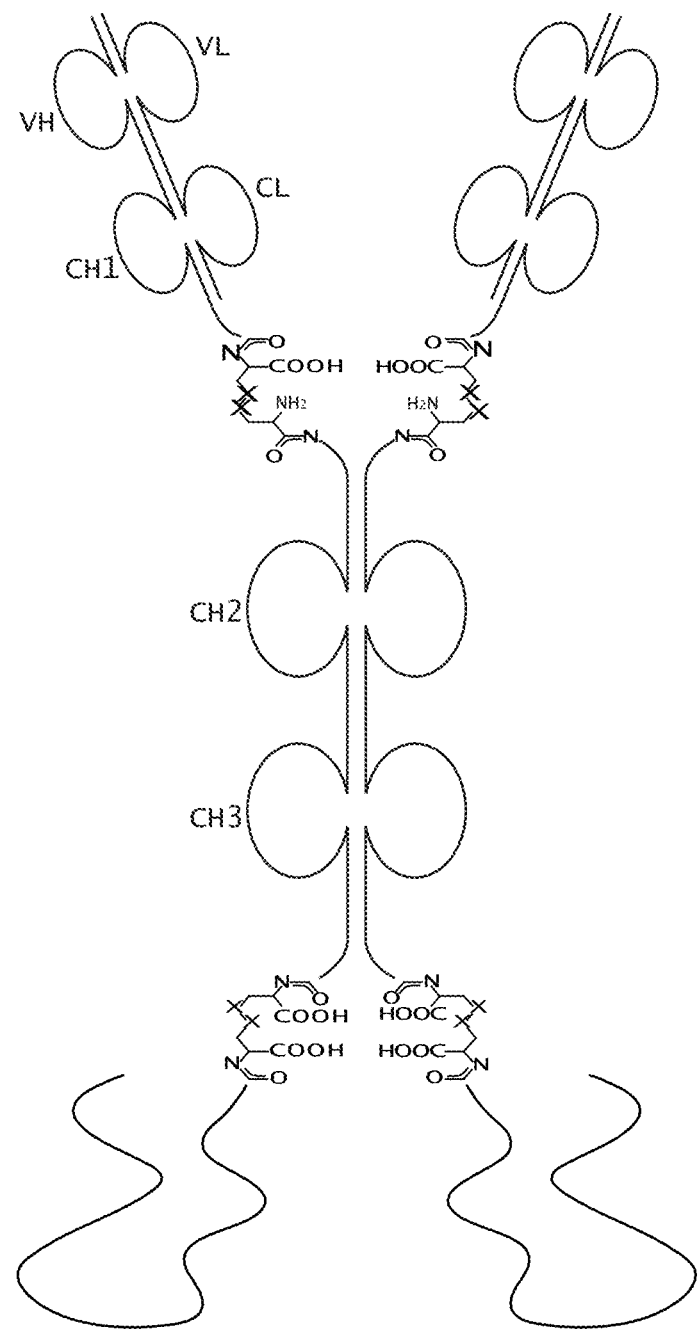
FIG. 27: Schematic representation of the X-cis-C conformation of a bi-immunosymmetroadhesin consisting of two Fab binding domains, one Fc domain, and two non-Fab binding domains. The molecule is a dimer of two hemi-symmetroadhesins each consisting of three stretches of consecutive amino acids.
Figure 28:
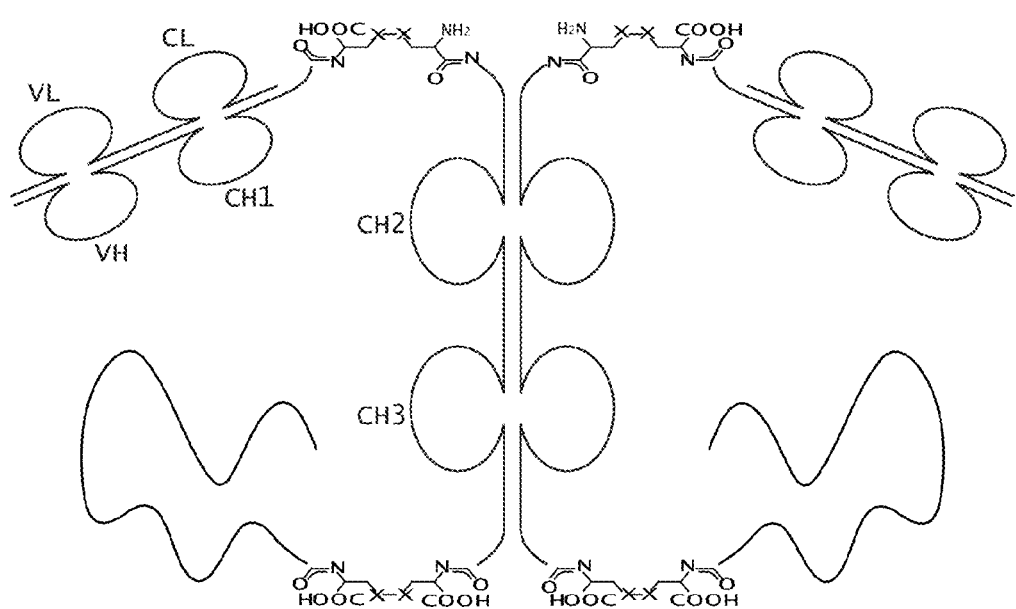
FIG. 28: Schematic representation of the X-cis-X conformation of a bi-immunosymmetroadhesin consisting of two Fab binding domains, one Fc domain, and two non-Fab binding domains. The molecule is a dimer of two hemi-symmetroadhesins each consisting of three stretches of consecutive amino acids.
Figure 29:
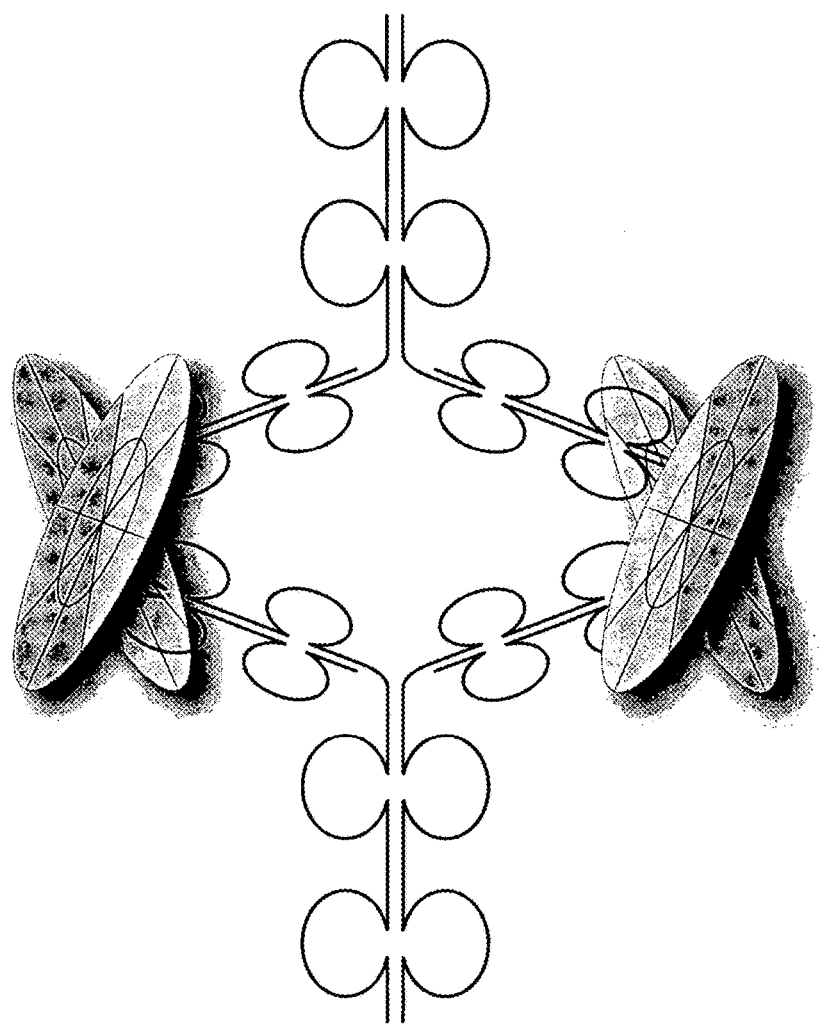
FIG. 29: Schematic representation of an immunoglobulin binding to a first symmetric target. The interaction is symmetric and cooperative. Both targets are bound by both immunoglobulins.
Figure 30:
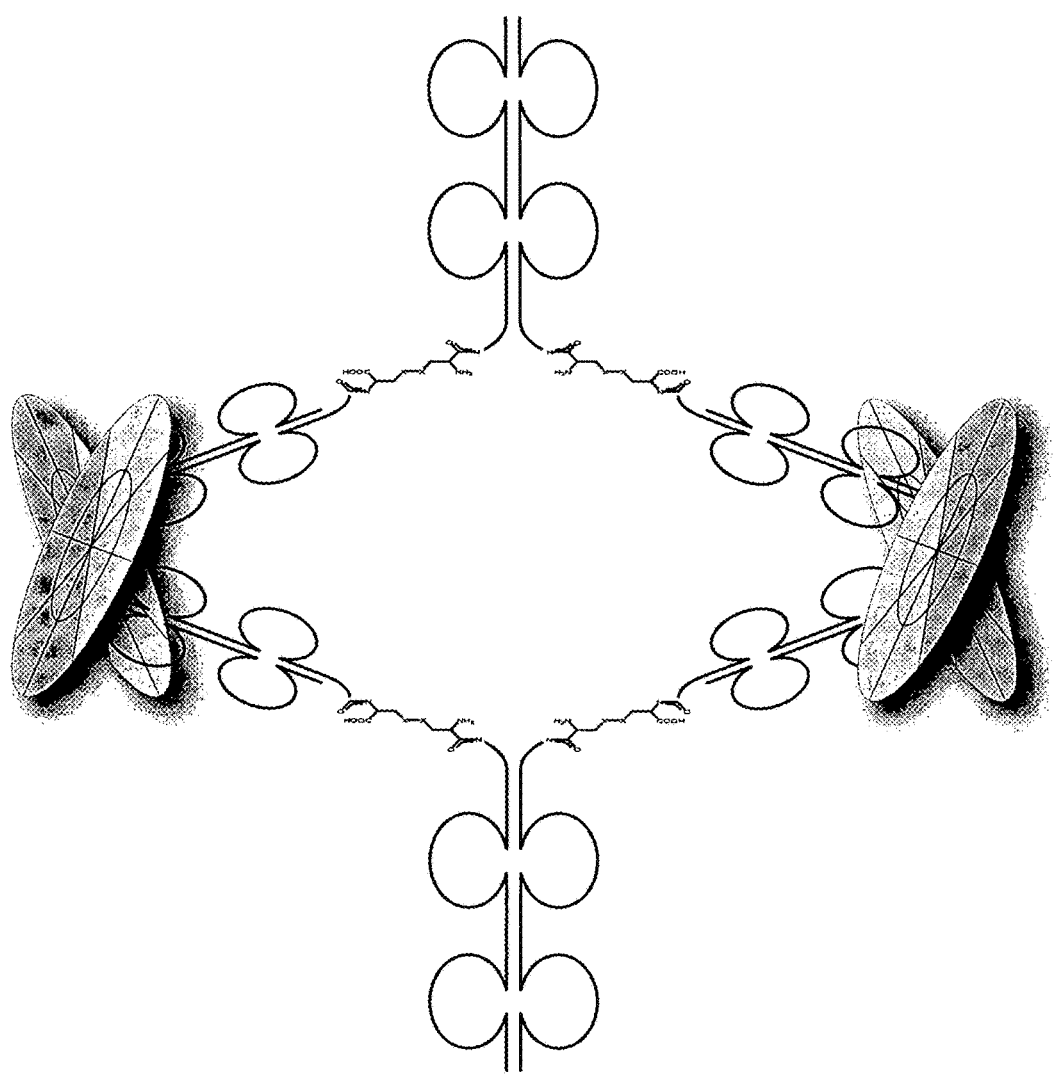
FIG. 30: Schematic representation of a symmetroadhesin binding to a first symmetric target. The interaction is symmetric and cooperative. Both targets are bound by both symmetroadhesins in a first conformation (all-trans).
Figure 31:
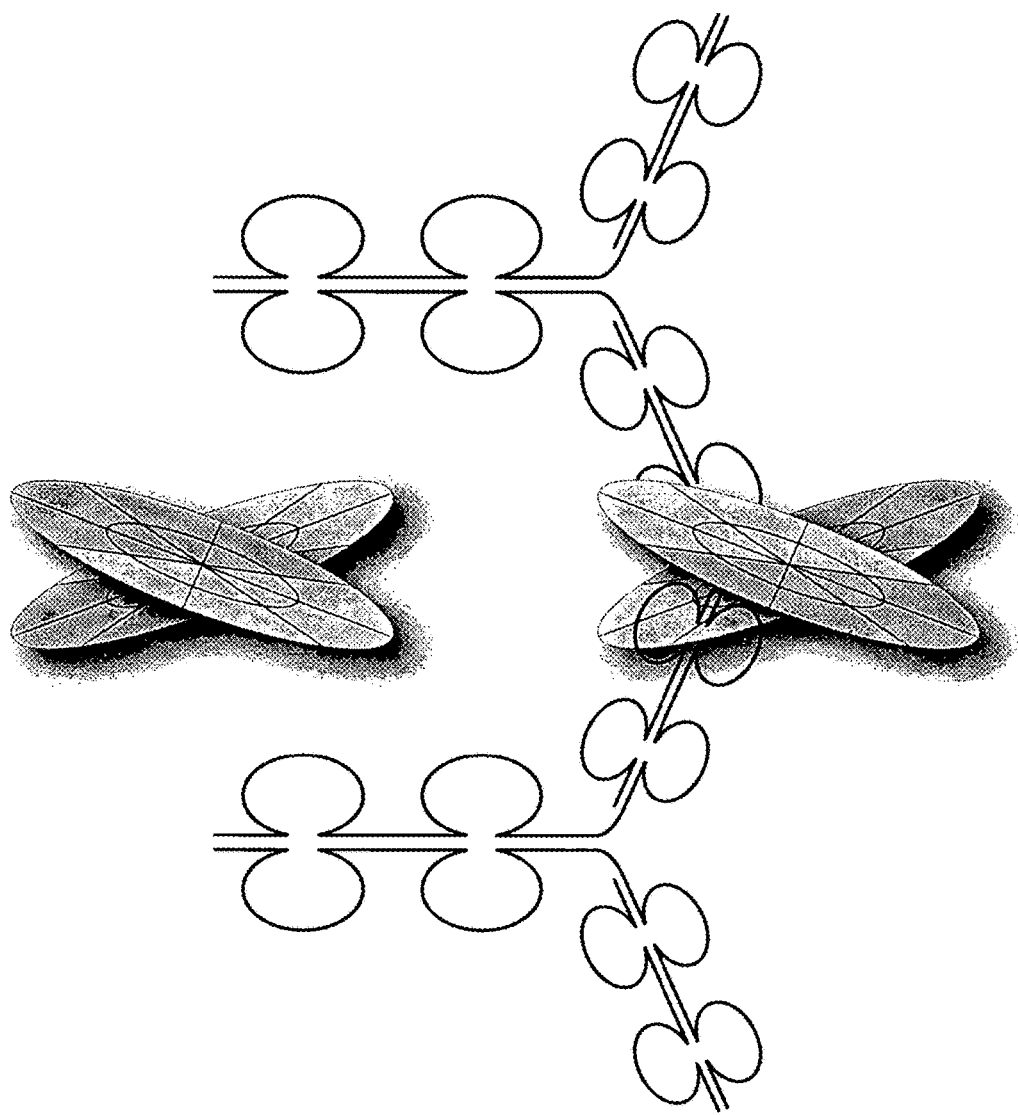
FIG. 31: Schematic representation of an immunoglobulin binding to a second symmetric target. The interaction is neither symmetric and nor cooperative. Only one target is bound by each immunoglobulin.
Figure 32:
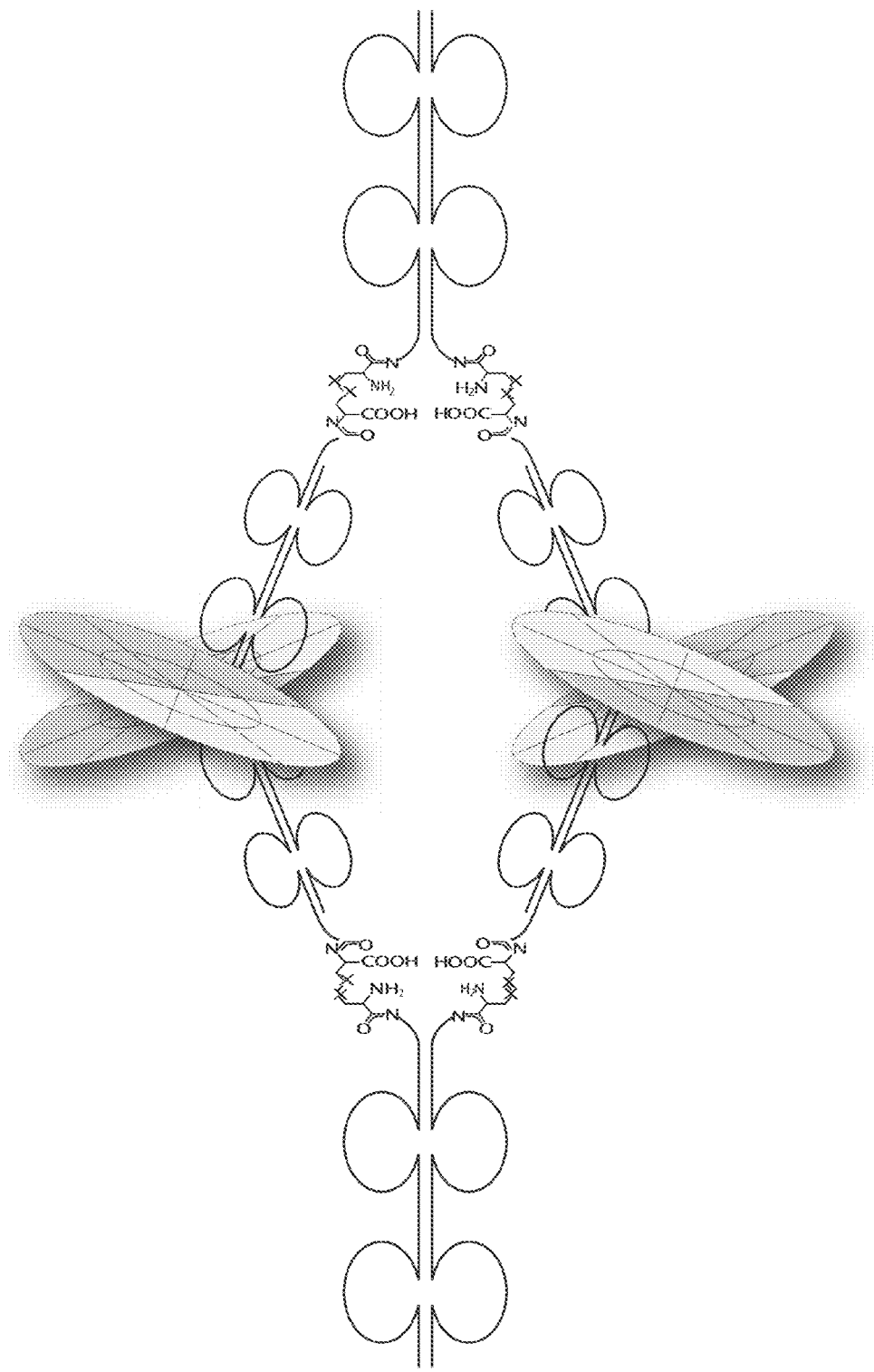
FIG. 32: Schematic representation of a symmetroadhesin binding to a second symmetric target. The interaction is symmetric and cooperative. Both targets are bound by both symmetroadhesins in a second conformation (X-cis-C).
Figure 33:
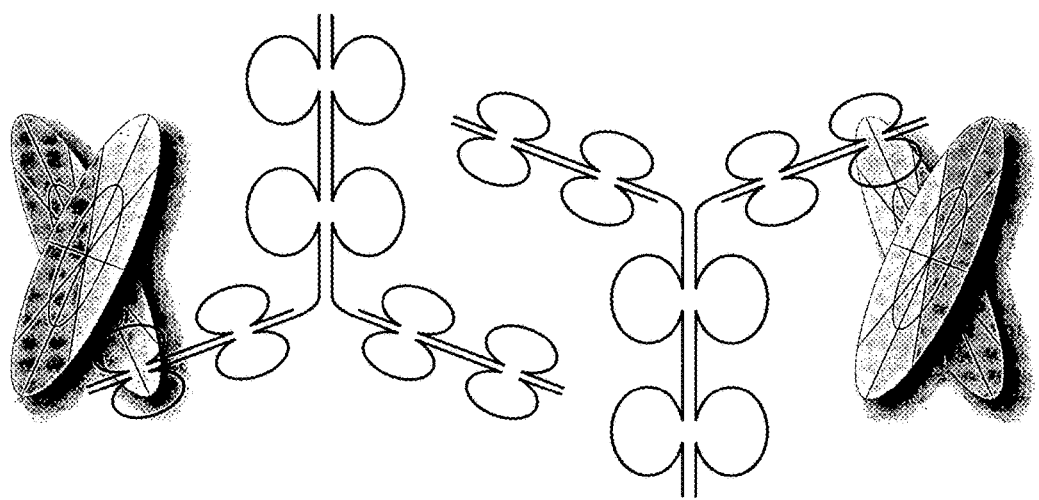
FIG. 33: Schematic representation of an immunoglobulin binding to a third symmetric target. The interaction is neither symmetric and nor cooperative. Only one target is bound by each immunoglobulin.
Figure 34:
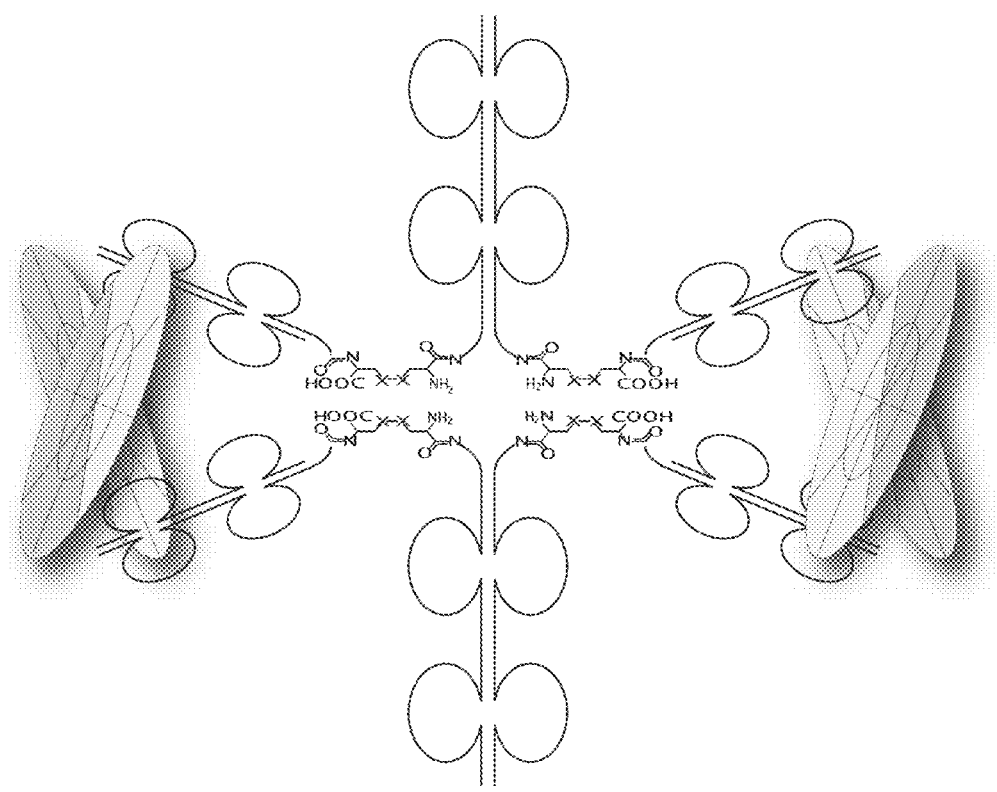
FIG. 34: Schematic representation of a symmetroadhesin binding to a third symmetric target. The interaction is symmetric and cooperative. Both targets are bound by both symmetroadhesins in a third conformation (X-cis-X).

FIG. 37A: Amino acid sequences of various polypeptide intermediates in an intein-based synthesis of a human Fc symmetroadhesin precursor subunit with a C-terminal-X-terminus. Part (i) shows two distinct pre-Fc-intein polypeptides comprising, alternatively, the human CD2 or CD4 signal sequences (residues −24 to −1, or −25 to −1, respectively), the human IGHG1 Fc domain (residues 1 to 224) beginning at the seventh amino acid encoded by the hinge exon (KTHTCPPCP), the human IGHG3 M1 domain (residues 225 to 241), and an Mth RIR1 intein-chitin binding domain (residues 242 to 441). The two distinct pre-Fc-intein chimeric polypeptides have lengths of 465 and 466 residues, respectively. Part (ii) shows the mature Fc-intein chimeric polypeptide (length=441) comprising the human Fc/M1 domain and the Mth RIR1 intein-chitin binding domain. The intein autocleavage site is underlined. Part (iii) shows the thioester-terminated human Fc/M1 domain (length=242). The C-terminal thio-glycine residue (Z) is underlined. Part (iv) shows the human Fc/M1 domain (length=243) with a C-terminal-X-terminus. The C-terminal X amino acid residue (e.g., cysteine, selenocysteine) is underlined. (IGHG1, UniProtKB/Swiss-Prot entry P01857, Ig gamma-1 chain C region, *Homo sapiens*; IGHG3, NCBI/GenBank accession BAA11363, membrane-bound-type Ig gamma-chain, *Homo sapiens*).

FIG. 37B: Amino acid sequences of various polypeptide synthetic intermediates of a human Fc symmetroadhesin precursor subunit with an C-terminal-S-terminus. Part (i) shows two distinct pre-Fc polypeptides comprising, alternatively, the human CD2 or CD4 signal sequences (residues −24 to −1, or −25 to −1, respectively), the human IGHG1 Fc domain (residues 1 to 224) beginning at the seventh amino acid encoded by the hinge exon (KTHTCPPCP), and a portion of the human IGHG3 M1 domain (residues 225 to 232). The two distinct pre-Fc polypeptides have lengths of 256 and 257 residues, respectively. Part (ii) shows the mature Fc domain (length=232) with an N-terminal-S-terminus. The N-terminal cysteine residue is underlined. (IGHG1, UniProtKB/Swiss-Prot entry P01857, Ig gamma-1 chain C region, *Homo sapiens*).

FIGS. 38A-38B: Amino acid sequences of various polypeptide intermediates in an intein-based synthesis of a human Fc symmetroadhesin precursor subunit, with an N-terminal-S-terminus and a C-terminal-X-terminus. (A) Part (i) shows three distinct pre-Fc-intein polypeptides comprising, alternatively, the human sonic hedgehog (SHH), human interferon alpha-2 (IFN), or human cholesterol ester transferase (CETP) signal sequences (residues −23 to −1, −23 to −1, or −17 to −1, respectively), the human IGHG1 Fc domain (residues 1 to 226) beginning at the fifth amino acid encoded by the hinge exon (CDKTHTCPPCP), the human IGHG3 M1 domain (residues 227 to 243), and an Mth RIR1 intein-chitin binding domain (residues 244 to 443). The three distinct pre-Fc-intein chimeric polypeptides have lengths of 466, 466 and 460 residues, respectively. Part (ii) shows the mature Fc-intein chimeric polypeptide (length=443) comprising the human Fc/M1 domain and the Mth RIR1 intein-chitin binding domain with an N-terminal-S-terminus. The N-terminal cysteine residue and intein autocleavage site are underlined. (B) Part (iii) shows the thioester-terminated human Fc/M1 domain (length=244). The N-terminal cysteine residue and C-terminal thio-glycine residue (Z) are underlined. Part (iv) shows the Fc/M1 domain (length=245) with an N-terminal-S-terminus and a C-terminal-X-terminus. The N-terminal cysteine residue and C-terminal X amino acid residue (e.g., cysteine, selenocysteine) are underlined. (IGHG1, UniProtKB/Swiss-Prot entry P01857, Ig gamma-1 chain C region, *Homo sapiens*; IGHG3, NCBI/GenBank accession BAA11363, membrane-bound-type Ig gamma-chain, *Homo sapiens*).

FIGS. 39A-39B: Amino acid sequences of various polypeptide intermediates in an intein-based synthesis of a human Fc symmetroadhesin precursor subunit, with an N-terminal-X-terminus and a C-terminal-X-terminus. (A) Part (i) shows three distinct pre-Fc-intein polypeptides comprising, alternatively, the human sonic hedgehog (SHH), human interferon alpha-2 (IFN), or human cholesterol ester transferase (CETP) signal sequences (residues −23 to −1, −23 to −1, or −17 to −1, respectively), the human IGHG1 Fc domain (residues 1 to 220) beginning at the eleventh amino acid encoded by the hinge exon (CPPCP), the human IGHG3 M1 domain (residues 221 to 237), and an Mth RIR1 intein-chitin binding domain (residues 238 to 437). The three distinct pre-Fc-intein chimeric polypeptides have lengths of 460, 460 and 454 residues, respectively. Part (ii) shows the mature Fc-intein chimeric polypeptide (length=437) comprising the human Fc/M1 domain and the Mth RIR1 intein-chitin binding domain with an N-terminal-S-terminus. The N-terminal cysteine residue and intein autocleavage site are underlined. (B) Part (iii) shows the mature Fc-intein chimeric polypeptide extended by native chemical ligation (length=443) to have an N-terminal-X-terminus. The N-terminal X amino acid (e.g., cysteine, selenocysteine) is underlined. Part (iv) shows the thioester-terminated human Fc/M1 domain (length=244). The N-terminal X amino acid residue and C-terminal thio-glycine residue (Z) are underlined. Part (v) shows the Fc/M1 domain (length=245) with an N-terminal-X-terminus and a C-terminal-X-terminus. The N-terminal X amino acid residue and C-terminal X amino acid residue are underlined. (IGHG1, UniProtKB/Swiss-Prot entry P01857, Ig gamma-1 chain C region, *Homo sapiens*; IGHG3, NCBI/GenBank accession BAA11363, membrane-bound-type Ig gamma-chain, *Homo sapiens*).

FIGS. 40A-40B: Amino acid sequences of various polypeptide intermediates in an intein-based synthesis of a human CD4 symmetroadhesin precursor subunit with a C-terminal-X-terminus. (A) Part (i) shows the pre-CD4-intein polypeptide (length=596) comprising the human CD4 signal sequence (residues −25 to −1) and extracellular domain (residues 1 to 371), and an Mth RIR1 intein-chitin binding domain (residues 372 to 571). Part shows the mature CD4-intein chimeric polypeptide (length=571) comprising the human CD4 extracellular domain and the Mth RIR1 intein-chitin binding domain. The position of the intein autocleavage site is underlined. (B) Part (iii) shows the thioester-terminated human CD4 extracellular domain (length=372). The C-terminal thio-glycine residue (Z) is underlined. Part (iv) shows the human CD4 extracellular domain (length=373) with a C-terminal-X-terminus. The C-terminal X amino acid residue (e.g., cysteine, selenocysteine) is underlined. (CD4, UniProtKB/Swiss-Prot entry P01730, T-cell surface glycoprotein CD4).

FIGS. 41A-41B: Amino acid sequences of various polypeptide intermediates in an intein-based synthesis of a Di62-VH symmetroadhesin precursor subunit with a C-terminal-X-terminus. (A) Part (i) shows the pre-Di62-VH-intein polypeptide (length=444) comprising the mouse Di62-VH signal sequence (residues −19 to −1) and variable domain (residues 1 to 117), the human CH1 constant domain (residues 118 to 225), and an Mth RIR1 intein-chitin binding domain (residues 226 to 425). Part (ii) shows the mature Di62-VH-intein chimeric polypeptide (length=425) comprising the mouse Di62-VH variable domain, the human CH1 constant domain, and the Mth RIR1 intein-chitin binding domain. The position of the intein autocleavage site is underlined. (B) Part (iii) shows the thioester-terminated mouse Di62-VH variable domain/human CH1 constant domain (length=226). The C-terminal thio-glycine residue (Z) is underlined. Part (iv) shows the mouse Di62-VH variable domain/human CH1 constant domain (length=227) with a C-terminal-X-terminus. The C-terminal X amino acid residue (e.g., cysteine, selenocysteine) is underlined. (Di62-VH, NCBI/GenBank accession CAA05416, IgG heavy chain, antigen binding of human TNF alpha subunit, *Mus musculus*).

FIG. 42: Amino acid sequences of various polypeptide synthetic intermediates of a Di62-Vk symmetroadhesin precursor subunit. Part (i) shows the pre-Di62-Vk polypeptide (length=234) comprising the mouse Di62-Vk signal sequence (residues −20 to −1) and variable domain (residues 1 to 107), and the human Ck constant domain (residues 108 to 214). Part (ii) shows the mature Di62-Vk chimeric polypeptide (length=214) comprising the mouse Di62-Vk variable domain, and the human Ck constant domain. (Di62-Vk, NCBI/GenBank accession CAA05417, IgG light chain, antigen binding of human TNF alpha subunit, *Mus musculus*).

FIG. 43: Amino acid sequences of various polypeptide intermediates in an intein-based synthesis of a human TNR1A symmetroadhesin precursor subunit with a C-terminal-X-terminus. Part (i) shows the pre-TNR1A-intein polypeptide (length=411) comprising the human TNR1A signal sequence (residues −21 to −1) and extracellular domain (residues 1 to 190), and an Mth RIR1 intein-chitin binding domain (residues 191 to 390). Part shows the mature TNR1A-intein chimeric polypeptide (length=390) comprising the human TNR1A extracellular domain and the Mth RIR1 intein-chitin binding domain. The position of the intein autocleavage site is underlined. Part (iii) shows the thioester-terminated human TNR1A extracellular domain (length=191). The C-terminal thio-glycine residue (Z) is underlined. Part (iv) shows the human TNR1A extracellular domain (length=192) with a C-terminal-X-terminus. The C-terminal X amino acid residue (e.g., cysteine, selenocysteine) is underlined. (TNR1A, UniProtKB/Swiss-Prot entry P19438, Tumor necrosis factor receptor superfamily member 1A).

FIG. 44A: Amino acid sequences of various polypeptide intermediates in an intein-based synthesis of a human TNR1B symmetroadhesin precursor subunit with a C-terminal-X-terminus. Part (i) shows the pre-TNR1B-intein polypeptide (length=457) comprising the human TNR1B signal sequence (residues −22 to −1) and extracellular domain (residues 1 to 235), and an Mth RIR1 intein-chitin binding domain (residues 236 to 435). Part (ii) shows the mature TNR1B-intein chimeric polypeptide (length=435) comprising the human TNR1B extracellular domain and the Mth RIR1 intein-chitin binding domain. The position of the intein autocleavage site is underlined. Part (iii) shows the thioester-terminated human TNR1B extracellular domain (length=236). The C-terminal thio-glycine residue (Z) is underlined. Part (iv) shows the human TNR1B extracellular domain (length=237) with a C-terminal-X-terminus. The C-terminal X amino acid residue (e.g., cysteine, selenocysteine) is underlined. (TNR1B, UniProtKB/Swiss-Prot entry 20333, Tumor necrosis factor receptor superfamily member 1B).

FIG. 44B: Amino acid sequences of various polypeptide synthetic intermediates of a TNR1B immunoadhesin precursor subunit. Part (i) shows the pre-TNR1B-immunoadhesin polypeptide (length=489) comprising the TNR1B signal sequence (residues −22 to −1) and extracellular domain (residues 1 to 235), and the human heavy constant domain (residues 236 to 467). Part (ii) shows the mature TNR1B-immunoadhesin (length=467).

FIGS. 45A-45C: Amino acid sequences of various polypeptide intermediates in an intein-based synthesis of a human VGFR1 symmetroadhesin precursor subunit with a C-terminal-X-terminus. (A) Part (i) shows the pre-VGFR1-intein polypeptide (length=958) comprising the human VGFR1 signal sequence (residues −26 to −1) and extracellular domain (residues 1 to 732), and an Mth RIR1 intein-chitin binding domain (residues 733 to 932). (B) Part (ii) shows the mature VGFR1-intein chimeric polypeptide (length=932) comprising the human VGFR1 extracellular domain and the Mth RIR1 intein-chitin binding domain. The position of the intein autocleavage site is underlined. (C) Part (iii) shows the thioester-terminated human VGFR1 extracellular domain (length=733). The C-terminal thio-glycine residue (Z) is underlined. Part (iv) shows the human VGFR1 extracellular domain (length=734) with a C-terminal-X-terminus. The C-terminal X amino acid residue (e.g., cysteine, selenocysteine) is underlined. (VGFR1, UniProtKB/Swiss-Prot entry P17948, Vascular endothelial growth factor receptor 1).

FIGS. 46A-46C: Amino acid sequences of various polypeptide intermediates in an intein-based synthesis of a human VGFR2 symmetroadhesin precursor subunit with a C-terminal-X-terminus. (A) Part (i) shows the pre-VGFR2-intein polypeptide (length=964) comprising the human VGFR2 signal sequence (residues −19 to −1) and extracellular domain (residues 1 to 745), and an Mth RIR1 intein-chitin binding domain (residues 746 to 945). (B) Part (ii) shows the mature VGFR2-intein chimeric polypeptide (length=945) comprising the human VGFR2 extracellular domain and the Mth RIR1 intein-chitin binding domain. The position of the intein autocleavage site is underlined. (C) Part (iii) shows the thioester-terminated human VGFR2 extracellular domain (length=746). The C-terminal thio-glycine residue (Z) is underlined. Part (iv) shows the human VGFR2 extracellular domain (length=747) with a C-terminal-X-terminus. The C-terminal X amino acid residue (e.g., cysteine, selenocysteine) is underlined. (VGFR2, UniProtKB/Swiss-Prot entry P35968, Vascular endothelial growth factor receptor 2).

FIGS. 47A-47C: Amino acid sequences of various polypeptide intermediates in an intein-based synthesis of a human VGFR3 symmetroadhesin precursor subunit with a C-terminal-X-terminus. (A) Part (i) shows the pre-VGFR3-intein polypeptide (length=975) comprising the human VGFR3 signal sequence (residues −24 to −1) and extracellular domain (residues 1 to 751), and an Mth RIR1 intein-chitin binding domain (residues 752 to 951). (B) Part (ii) shows the mature VGFR3-intein chimeric polypeptide (length=951) comprising the human VGFR3 extracellular domain and the Mth RIR1 intein-chitin binding domain. The position of the intein autocleavage site is underlined. (C) Part (iii) shows the thioester-terminated human VGFR3 extracellular domain (length=752). The C-terminal thioglycine residue (Z) is underlined. Part (iv) shows the human VGFR3 extracellular domain (length=753) with a C-terminal-X-terminus. The C-terminal X amino acid residue (e.g., cysteine, selenocysteine) is underlined. (VGFR3, UniProtKB/Swiss-Prot entry P35916, Vascular endothelial growth factor receptor 3).

FIGS. 48A-48B: Amino acid sequences of various polypeptide intermediates in an intein-based synthesis of a human ERBB1 symmetroadhesin precursor subunit with a C-terminal-X-terminus. (A) Part (i) shows the pre-ERBB1-intein polypeptide (length=845) comprising the human ERBB1 signal sequence (residues −24 to −1) and extracellular domain (residues 1 to 621), and an Mth RIR1 intein-chitin binding domain (residues 622 to 821). Part (ii) shows the mature ERBB1-intein chimeric polypeptide (length=821) comprising the human ERBB1 extracellular domain and the Mth RIR1 intein-chitin binding domain. The position of the intein autocleavage site is underlined. (B) Part (iii) shows the thioester-terminated human ERBB1 extracellular domain (length=622). The C-terminal thioglycine residue (Z) is underlined. Part (iv) shows the human ERBB1 extracellular domain (length=623) with a C-terminal-X-terminus. The C-terminal X amino acid residue (e.g., cysteine, selenocysteine) is underlined. (ERBB1, UniProtKB/Swiss-Prot entry P00533, Epidermal growth factor receptor).

FIGS. 49A-49B: Amino acid sequences of various polypeptide intermediates in an intein-based synthesis of a human ERBB2 symmetroadhesin precursor subunit with a C-terminal-X-terminus. (A) Part (i) shows the pre-ERBB2-intein polypeptide (length=852) comprising the human ERBB2 signal sequence (residues −22 to −1) and extracellular domain (residues 1 to 630), and an Mth RIR1 intein-chitin binding domain (residues 631 to 830). Part (ii) shows the mature ERBB2-intein chimeric polypeptide (length=830) comprising the human ERBB2 extracellular domain and the Mth RIR1 intein-chitin binding domain. The position of the intein autocleavage site is underlined. (B) Part (iii) shows the thioester-terminated human ERBB2 extracellular domain (length=631). The C-terminal thioglycine residue (Z) is underlined. Part (iv) shows the human ERBB2 extracellular domain (length=632) with a C-terminal-X-terminus. The C-terminal X amino acid residue (e.g., cysteine, selenocysteine) is underlined. (ERBB2, UniProtKB/Swiss-Prot entry P04626, Receptor tyrosine-protein kinase erbB-2).

FIGS. 50A-50B: Amino acid sequences of various polypeptide intermediates in an intein-based synthesis of a human ERBB3 symmetroadhesin precursor subunit with a C-terminal-X-terminus. (A) Part (i) shows the pre-ERBB3-intein polypeptide (length=843) comprising the human ERBB3 signal sequence (residues −19 to −1) and extracellular domain (residues 1 to 624), and an Mth RIR1 intein-chitin binding domain (residues 625 to 824). Part (ii) shows the mature ERBB3-intein chimeric polypeptide (length=824) comprising the human ERBB3 extracellular domain and the Mth RIR1 intein-chitin binding domain. The position of the intein autocleavage site is underlined. (B) Part (iii) shows the thioester-terminated human ERBB3 extracellular domain (length=625). The C-terminal thioglycine residue (Z) is underlined. Part (iv) shows the human ERBB3 extracellular domain (length=626) with a C-terminal-X-terminus. The C-terminal X amino acid residue (e.g., cysteine, selenocysteine) is underlined. (ERBB3, UniProtKB/Swiss-Prot entry P21860, Receptor tyrosine-protein kinase erbB-3).

FIGS. 51A-51B: Amino acid sequences of various polypeptide intermediates in an intein-based synthesis of a human ERBB4 symmetroadhesin precursor subunit with a C-terminal-X-terminus. (A) Part (i) shows the pre-ERBB4-intein polypeptide (length=851) comprising the human ERBB4 signal sequence (residues −25 to −1) and extracellular domain (residues 1 to 626), and an Mth RIR1 intein-chitin binding domain (residues 627 to 826). Part (ii) shows the mature ERBB4-intein chimeric polypeptide (length=826) comprising the human ERBB4 extracellular domain and the Mth RIR1 intein-chitin binding domain. The position of the intein autocleavage site is underlined. (B) Part (iii) shows the thioester-terminated human ERBB4 extracellular domain (length=627). The C-terminal thioglycine residue (Z) is underlined. Part (iv) shows the human ERBB4 extracellular domain (length=628) with a C-terminal-X-terminus. The C-terminal X amino acid residue (e.g., cysteine, selenocysteine) is underlined. (ERBB4, UniProtKB/Swiss-Prot entry Q15303, Receptor tyrosine-protein kinase erbB-4).

Figure 52:
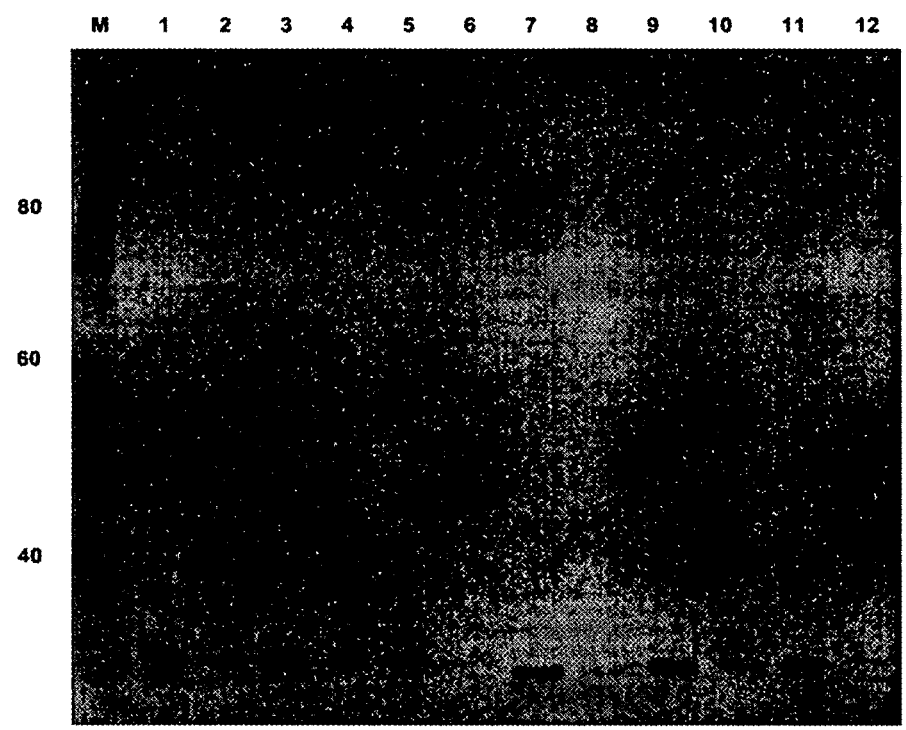

FIG. 52: Expression in 293 kidney cells of human IgG1 Fc symmetroadhesin subunits with N-terminal-S-termini. Lanes 1-6 and lanes 7-12 show the IgG1 Fc polypeptides of FIG. 35A (ii) and FIG. 36A (ii), respectively. Cell supernatants: lanes 1, 3, 5, 7, 9 and 11; cell lysates: lanes 2, 4, 6, 8, 10 and 12. Signal sequences used: SHH (lanes 1, 2, 7 and 8); IFNA (lanes 3, 4, 9, 10); CETP (lanes 5, 6, 11 and 12).

Figure 53:
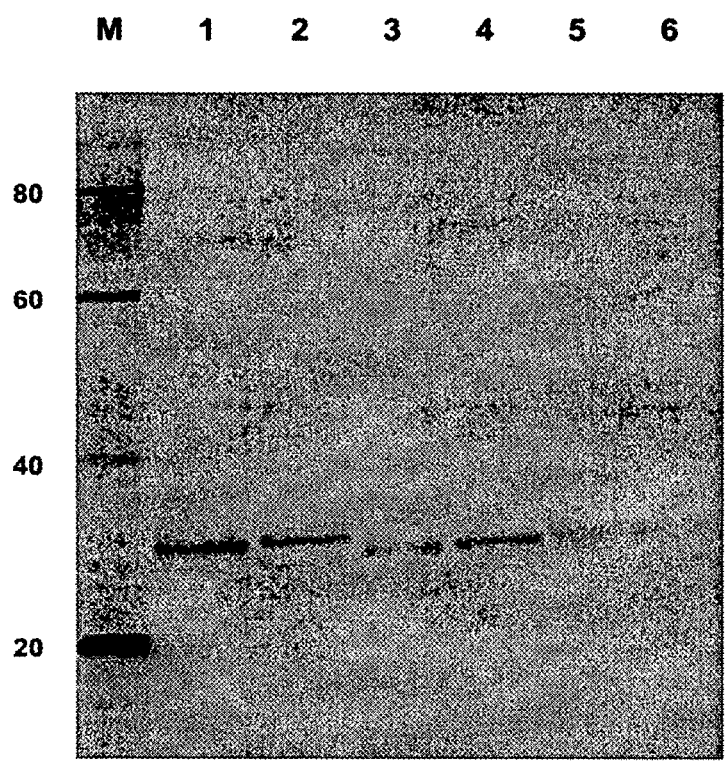

FIG. 53: Expression in 293 kidney cells of human IgG1 Fc symmetroadhesin subunits. Lanes 1-2, 3-4 and 5-6 show the IgG1 Fc polypeptides of FIG. 35A (ii), FIG. 36A (ii) and FIG. 37B (ii), respectively. Cell supernatants: (lanes 1-6). Signal sequences used: SHH (lanes 1-6).

Figure 54:
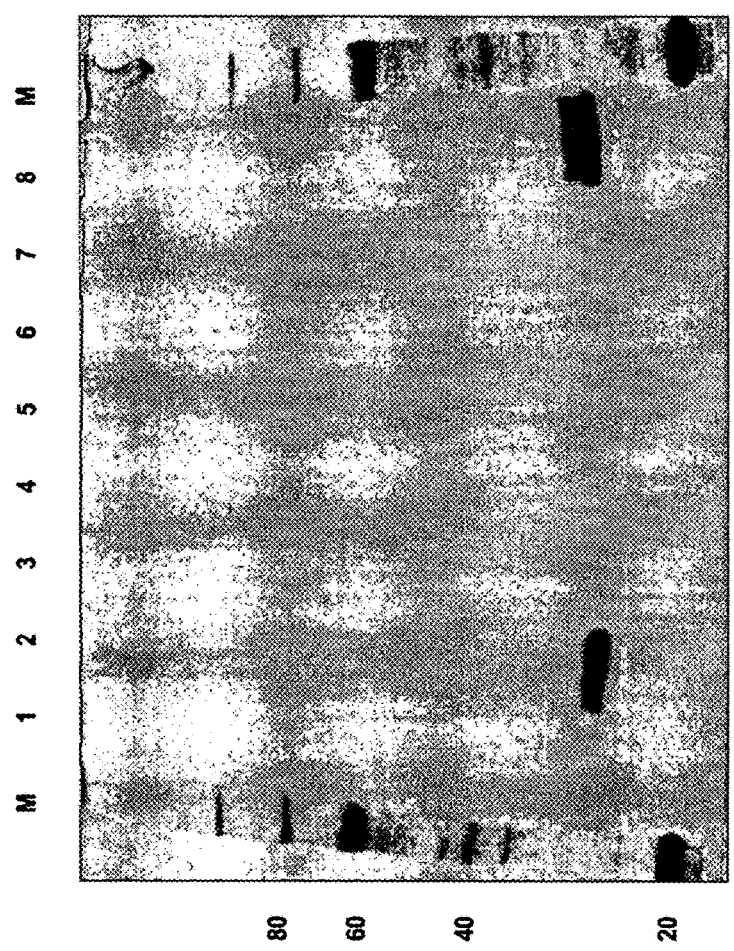

FIG. 54: Protein A purification of human IgG1 Fc symmetroadhesin subunits expressed in 293 kidney cells. Lane 2 and 8 show the IgG1 Fc polypeptides of FIG. 36A and FIG. 35A, respectively. Lanes 1-7: proteinA-sepharose column fractions for the IgG1 Fc polypeptide of FIG. 36A.

Figure 55:
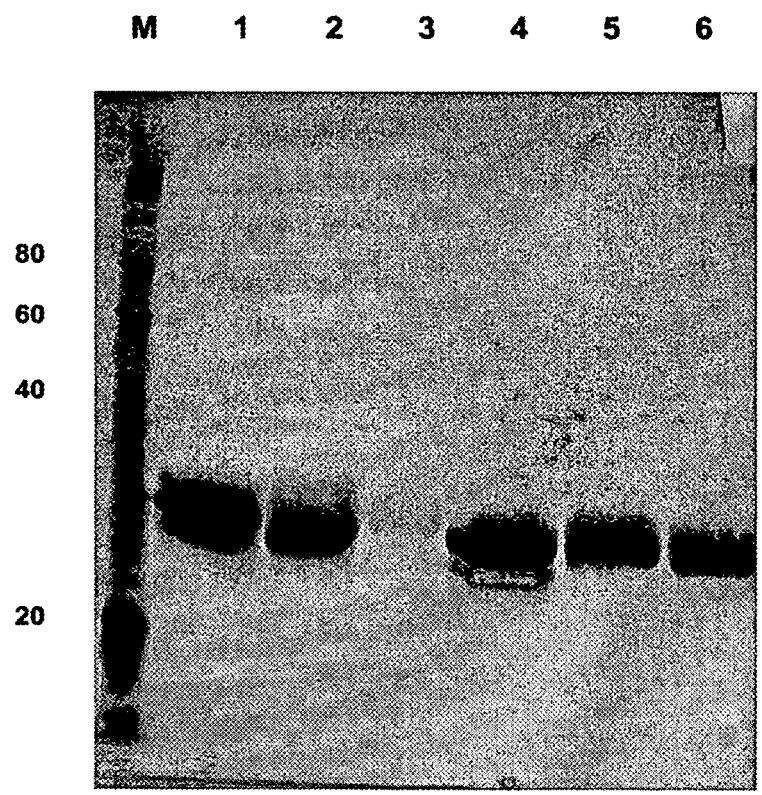

FIG. 55: Thiol-sepharose binding of proteinA-purified human IgG1 Fc symmetroadhesin subunits shown in FIG. 54. Lanes 1-3 and lanes 4-6 show the human IgG1 Fc polypeptides of FIG. 35A and FIG. 36A, respectively. Lanes 1 and 4: starting material; lanes 2 and 5: thiol-sepharose flow-thru fraction; lanes 3 and 6: thiol-sepharose bound fraction.

Figure 56:
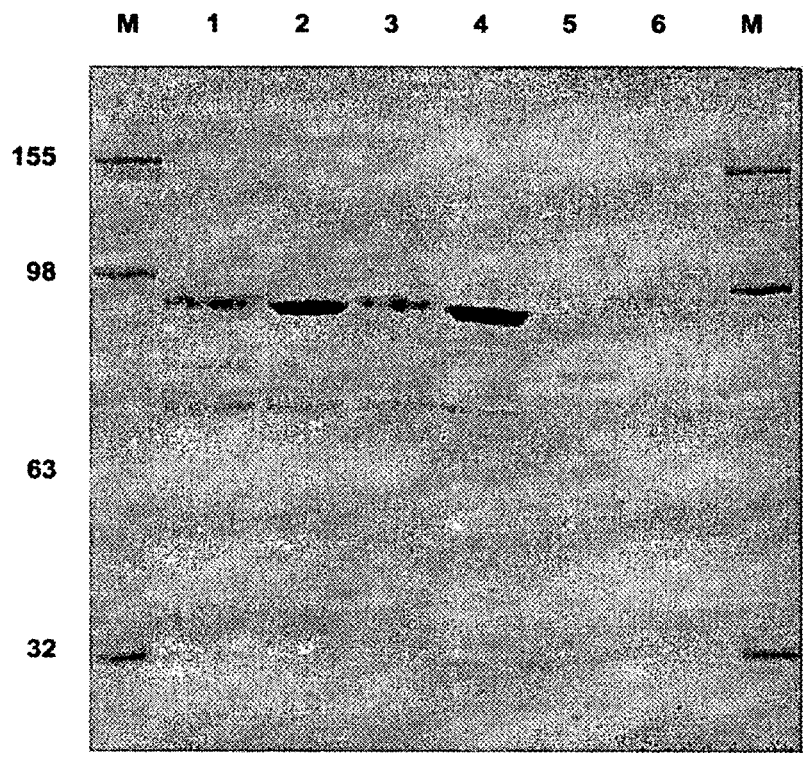

FIG. 56: Expression in human 293 kidney cells of human CD4-intein fusion proteins. Lanes 1-4 show the CD4-intein fusion polypeptide of FIG. 40A (ii). Cell supernatants: lanes 1 and 3; cell lysates: lanes 2 and 4.

Figure 57:
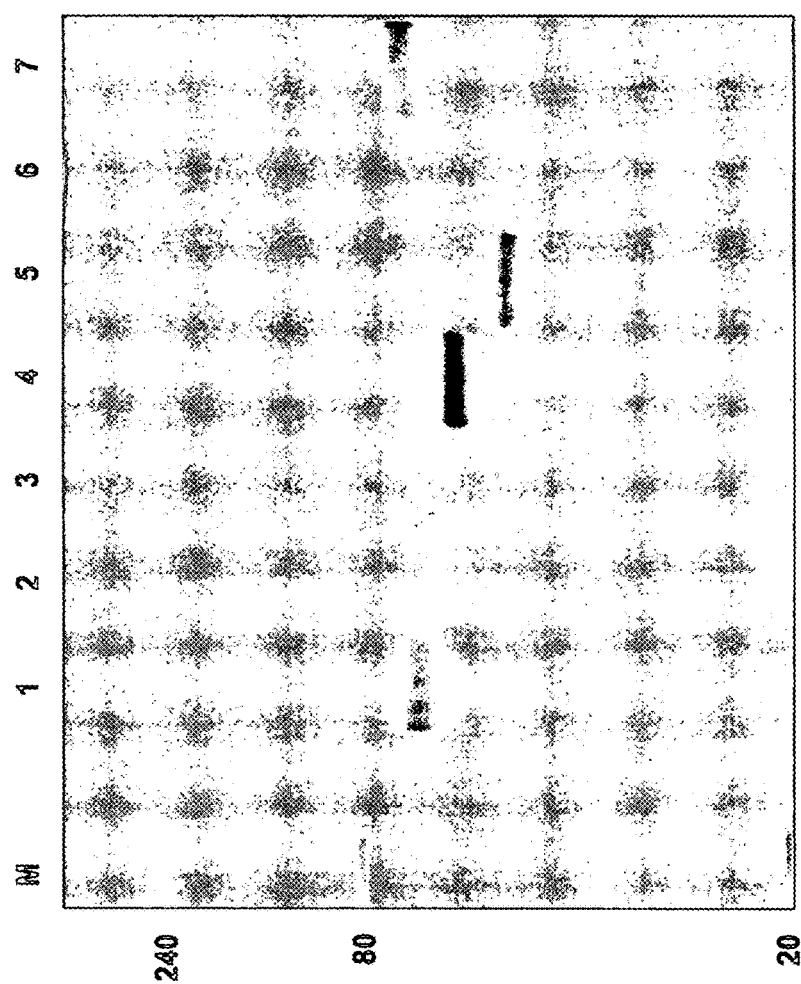

FIG. 57: Expression in human 293 kidney cells of human TNR1B fusion proteins. Lanes 2 and 5 show the TNR1B-intein fusion protein of FIG. 44A (ii). Lanes 1 and 3 show the TNR1B-immunoadhesin fusion protein of FIG. 44B (ii). Lanes 3 and 6 show proteins from mock-transfected cells. Cell supernatants: lanes 1-3; cell lysates: lanes 4-7. Lane 7: control TNR1B-immunoadhesin (R&D Systems).

FIG. 58: TNR1B symmetroadhesin subunits with C-terminal-S-termini. Lanes 1-2 show the TNR1B polypeptide of FIG. 44A (iii) following purification by chitin affinity chromatography and cleavage/elution with MESNA. Lanes 3 shows the native ligation product between the TNR1B polypeptide of FIG. 44A (iii) with a fluorescent-labeled peptide (New England Biolabs). Panel (i): direct fluorescence; panel (ii): western blot with anti-TNR1B antibody (R&D Systems); panel (iii): SYPRO Ruby staining (Sigma-Aldrich).

Figure 59:
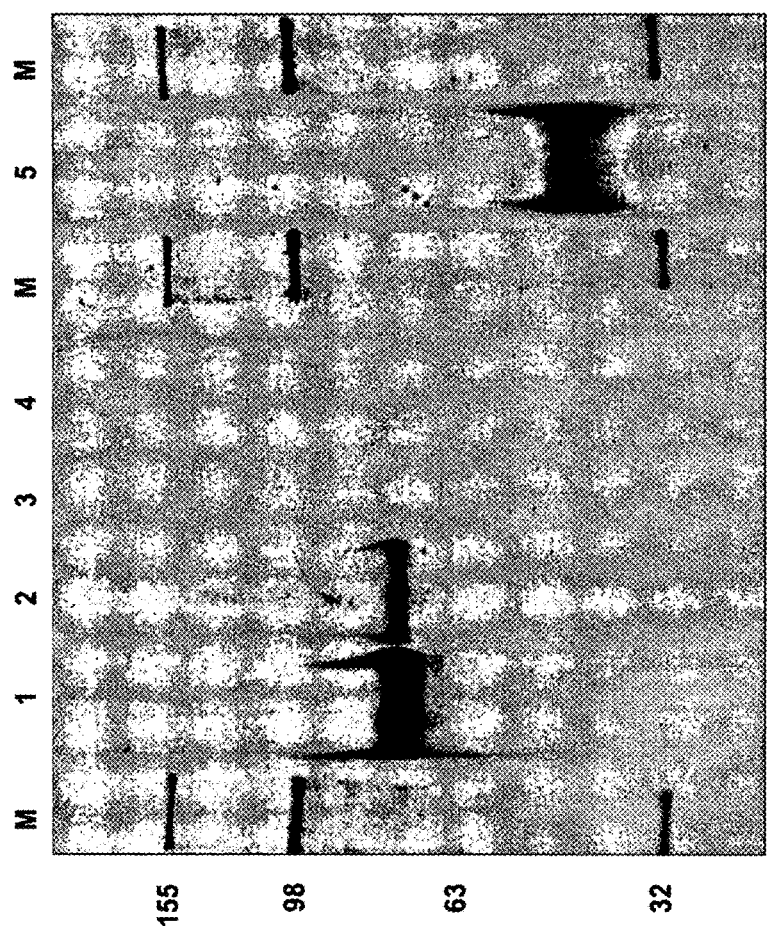

FIG. 59: TNR1B symmetroadhesin subunits with C-terminal-S-termini. Lane 5 shows the TNR1B polypeptide of FIG. 44A (iv) following purification by chitin affinity chromatography and cleavage/elution with cysteine. Lanes 1-4 show TNR1B-immunoadhesin.

Figure 60:
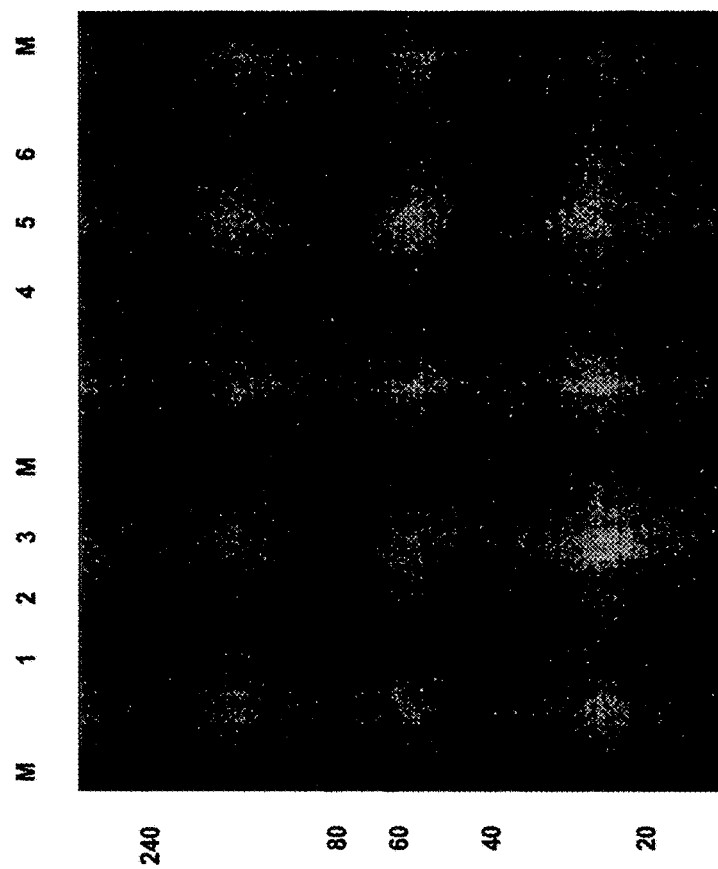

FIG. 60: TNR1B symmetroadhesin. Lanes 1-4 show the TNR1B symmetroadhesin of FIG. 44A (iv) before oxidation (lanes 1 and 4) and after oxidation in the presence of 10 mM CuSO4. Lanes 3 and 6 show a TNR1B-immunoadhesin control. Lanes 1-3: reducing conditions; lanes 4-6: non-reducing conditions. The TNR1B symmetroadhesin monomer (42 kd) and dimer (84 kd) are apparent in lanes 2 and 5, and lane 5, respectively.

Figure 61A:
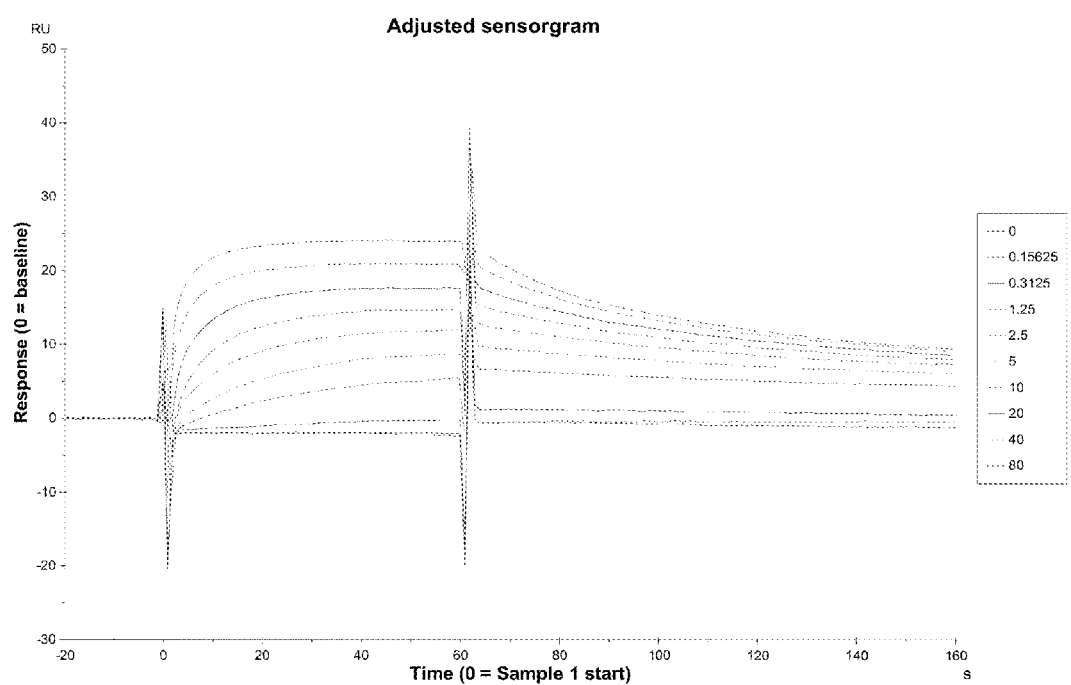
Figure 61B:
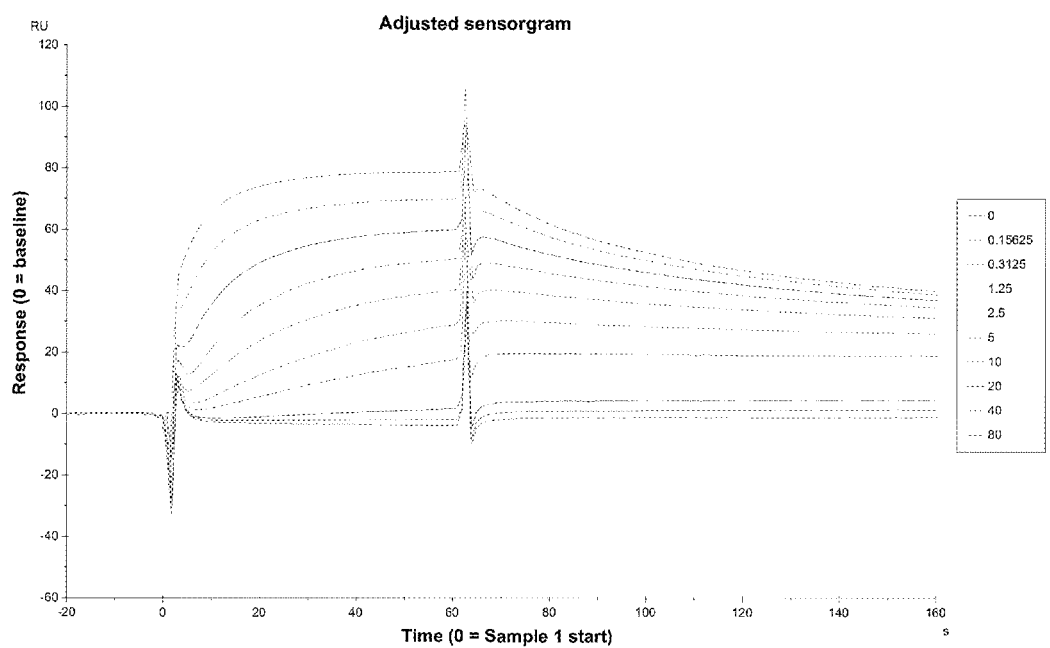
Figure 61C:
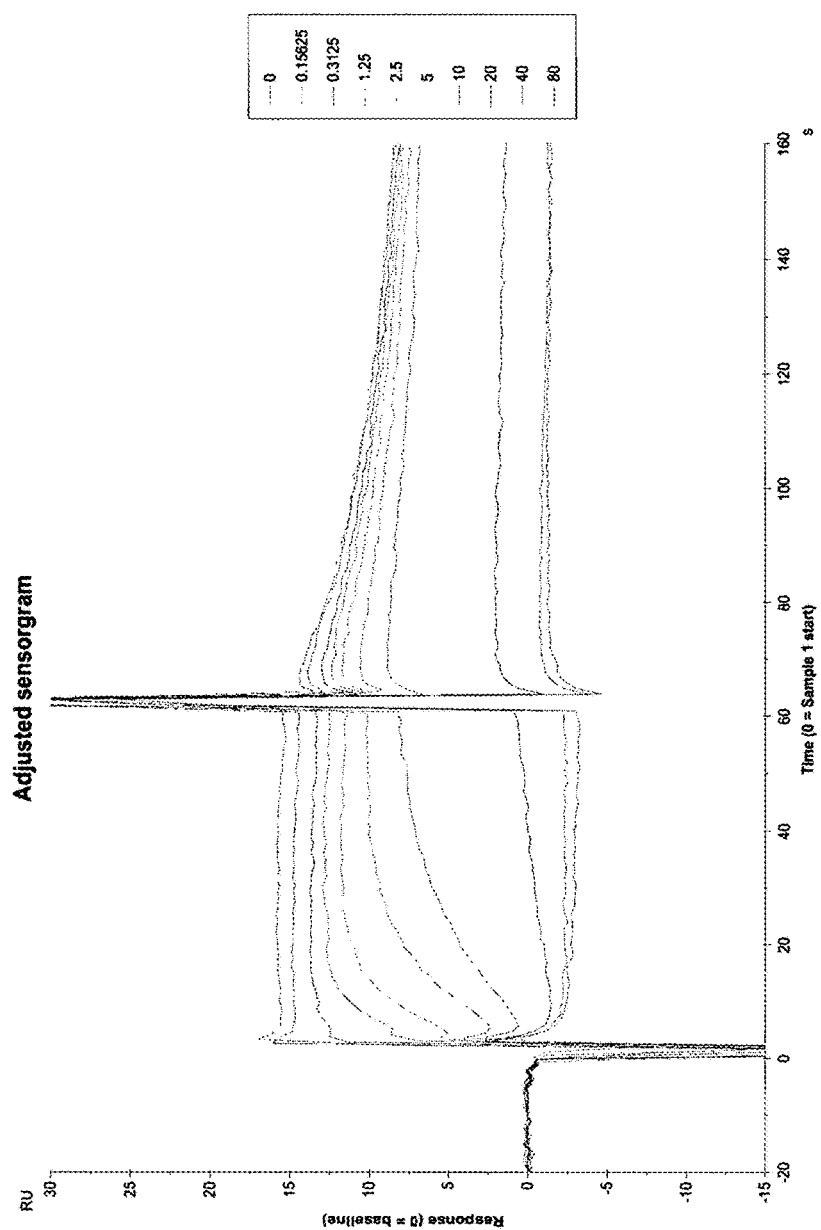

FIG. 61A-61C: TNF-alpha saturation binding analysis with various TNR1B polypeptides on the Biacore T-100. (A) The TNR1B symmetroadhesin of FIG. 44A (iv) was covalently coupled to a Biacore CM-5 chip using standard Biacore amine chemistry. (B) TNR1B immunoadhesin (R&D Systems) was covalently coupled to a Biacore CM-5 chip using standard Biacore amine chemistry. (C) The TNR1B symmetroadhesin of FIG. 44A (iv) was covalently coupled to a Biacore CM-5 chip using standard Biacore thiol chemistry. Following coupling, saturation binding analysis was carried out using TNF-alpha (R&D Systems) at the indicated concentrations.

Figure 62A:
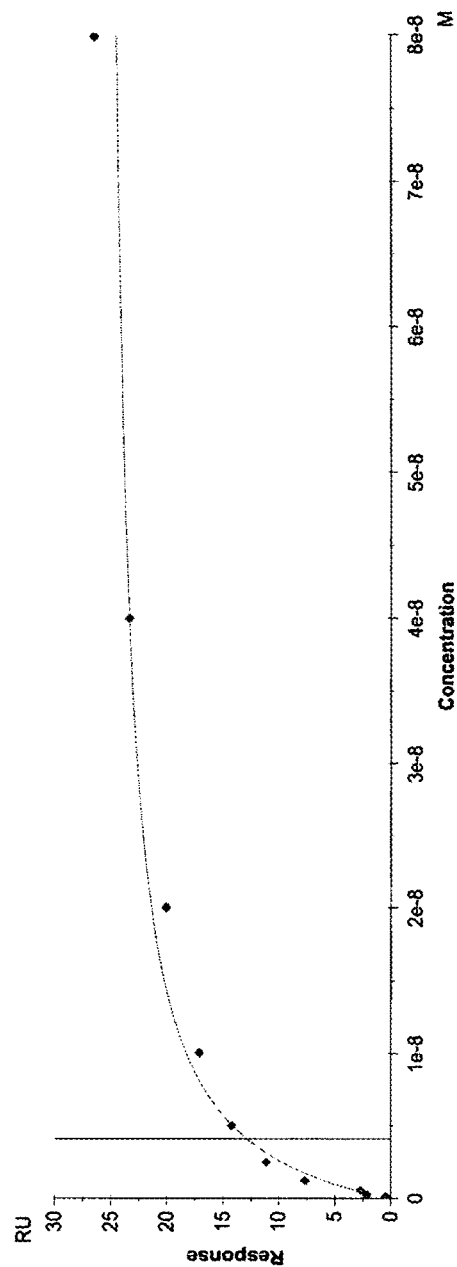
Figure 62B:
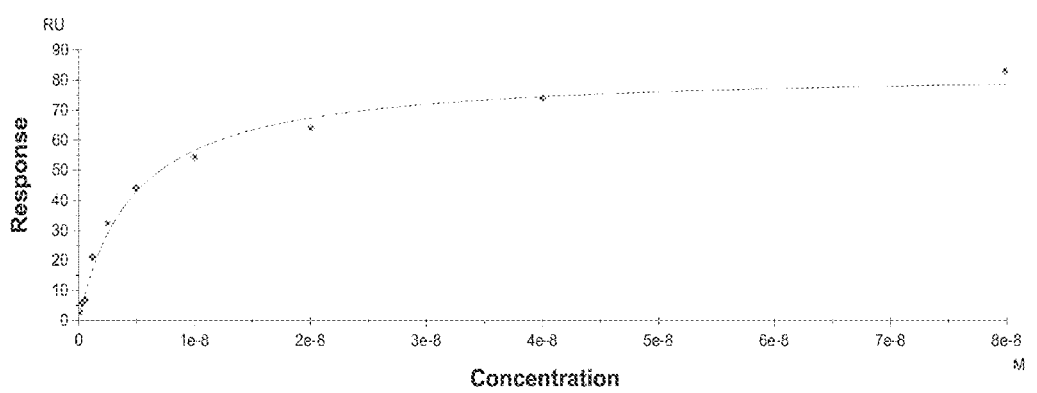
Figure 62C:
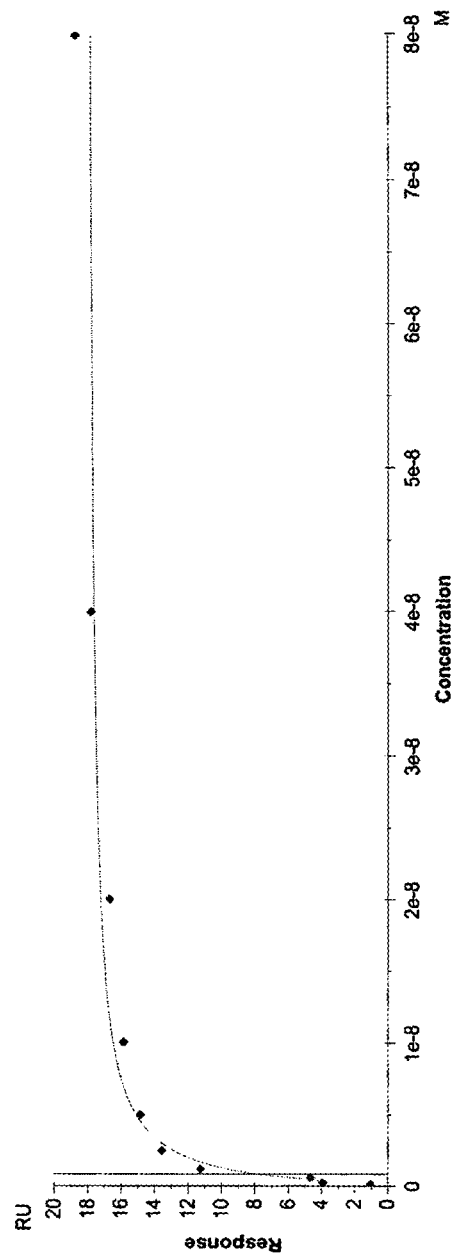

FIG. 62A-62C: Scatchard analysis of the TNF-alpha saturation binding analysis shown in FIG. 61A-61C. (A) TNR1B symmetroadhesin of FIG. 44A (iv) covalently coupled using amine chemistry; Kd=Kd=$4.697 \times 10^{-9}$ M. (B) TNR1B-immunoadhesin (R&D Systems) covalently coupled using amine chemistry; Kd=$4.089 \times 10^{-9}$ M. (C) TNR1B symmetroadhesin of FIG. 44A (iv) covalently coupled using thiol chemistry; Kd=$0.8476 \times 10^{-9}$ M.

DETAILED DESCRIPTION

This invention provides a compound comprising a first stretch of consecutive amino acids, each of which is joined to the preceding amino acid by a peptide bond and the sequence of which comprises a binding site for a target; and a second stretch of consecutive amino acids, each of which is joined to the preceding amino acid by a peptide bond and the sequence of which is identical to the sequence of the first stretch of consecutive amino acids and which comprises an identical binding site for the target; wherein each of the first stretch of amino acids and the second stretch of amino acids has at a predefined end thereof a cysteine residue or a selenocysteine residue and such cysteine residues or such selenocysteine residues are joined by a bond having the structure:

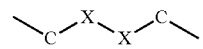

wherein each X is the same and represents a sulfur (S) or a selenium (Se) and each C represents a beta-carbon of one of such cysteine or selenocysteine residues.

In an embodiment, the bond has the structure:

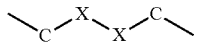

In an embodiment, the residue at the predefined end of each of the first stretch and the second stretch of consecutive amino acids is a cysteine residue. In an embodiment the residue at the predefined end of each of the first stretch and the second stretch of consecutive amino acids is a selenocysteine residue.

This invention also provides a compound comprising a first stretch of consecutive amino acids, each of which is joined to the preceding amino acid by a peptide bond and the sequence of which comprises a binding site for a target; and a second stretch of consecutive amino acids, each of which is joined to the preceding amino acid by a peptide bond and the sequence of which is different from the sequence of the first stretch of consecutive amino acids and which comprises a binding site for a different moiety; wherein each of the first stretch of amino acids and the second stretch of amino acids has at a predefined end thereof a cysteine residue or a selenocysteine residue and such residues are joined by a bond having the structure:

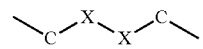

wherein each X may be the same or different and represents a sulfur (S) or a selenium (Se) and each C represents a beta-carbon of one of such cysteine or selenocysteine residues.

In an embodiment the bond has the structure:

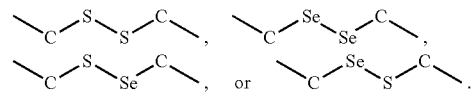

In an embodiment both of the residues at the predefined ends of each of the first stretch of amino acids and the second stretch of amino acids are cysteine residues. In an embodiment both of the residues at the predefined ends of each of the first stretch of amino acids and the second stretch of amino acids are selenocysteine residues. In an embodiment the residue at one predefined end of one of the first stretch or second stretch of consecutive amino acids is a cysteine residue and the residue at the other predefined end is a selenocysteine residue.

This invention provides a multimer comprising two or more identical instant compounds joined together by at least one bond. In an embodiment the multimer is a dimer. In an embodiment the multimer is a trimer. In an embodiment the multimer is a tetramer. In an embodiment of the multimer, the one or more bonds comprises a disulfide bond.

In an embodiment of the compounds the predefined end of both the first stretch of amino acids and the second stretch of amino acids is a N-terminal end thereof. In an embodiment the predefined end of both the first stretch of amino acids and the second stretch of amino acids is a C-terminal end thereof. In an embodiment the predefined end of one of the first stretch of amino acids and the second stretch of amino acids is a C-terminal end and the other predefined end is a N-terminal end.

In an embodiment of the compounds, the first stretch of amino acids comprises L-amino acids. In an embodiment, the first stretch of amino acids comprises D-amino acids. In an embodiment, the first stretch of amino acids comprises L-amino acids and D-amino acids In an embodiment, the second stretch of amino acids comprises L-amino acids. In an embodiment, the second stretch of amino acids comprises D-amino acids. In an embodiment, the second stretch of amino acids comprises L-amino acids and D-amino acids.

In an embodiment, the first stretch of amino acids comprises at least 50 consecutive amino acids. In an embodiment the second stretch of amino acids comprises at least 50 consecutive amino acids. In an embodiment, the first and/or second stretch of amino acids is between 1 and 100, 100 and 200 or 200 and 300 amino acids in length. In an embodiment the first stretch or second stretch of amino acids comprises at least 20, 25, 30, 35, 40, or 45 consecutive amino acids.

In an embodiment, the first stretch of amino acids comprises more than one type of amino acid. In an embodiment, the second stretch of amino acids comprises more than one type of amino acid.

In an embodiment of the instant compounds, the sequence of the first and/or second stretch of amino acids corresponds to the sequence of a constant region of an immunoglobulin. In an embodiment, the immunoglobulin is a human immunoglobulin. In an embodiment, the constant region of the immunoglobulin is a constant region of an IgG, an IgA, an IgE, an IgD, or an IgM immunoglobulin. In an embodiment, the constant region of the immunoglobulin is a constant region of an IgG-1, IgG-2, IgG-3 or IgG-4 immunoglobulin. In an embodiment, the constant region of the immunoglobulin which is a constant region of an IgG-1, IgG-2, IgG-3 or IgG-4 immunoglobulin has one of the sequences set forth herein. In an embodiment, the constant region of the immunoglobulin is a constant region of an IgG immunoglobulin and comprises a hinge region, a CH6 region and a CH3 region. In an embodiment, the different moiety is an immunoeffector or immunoregulator.

In an embodiment, the target is protein. In an embodiment, the target is an EGF receptor, a HER2, a VEGF receptor, a CD20 antigen, a CD11a, an IgE immunoglobulin, a glycoprotein IIa receptor, a glycoprotein IIIa receptor, a TNF alpha, or a TNF receptor, a gp120. In an embodiment, each of the first and second stretch of consecutive amino acids comprises the amino acid sequence of any one of TNFRSF1a, TNFRSF1b, VEGFR1, VEGFR6, VEGFR3, human Erb1, human Erb2, human Erb6, human Erb3, or human Erb4. In an embodiment, the first or second stretch of consecutive amino acids comprises the amino acid sequence set forth of any one of TNFRSF1a, TNFRSF1b, VEGFR1, VEGFR6, VEGFR3, human Erb1, human Erb2, human Erb6, human Erb3, or human Erb4).

This invention provides a composition comprising any of the instant compounds in an amount effective to bind the target, and a carrier. In an embodiment, the compound is in an amount effective to bind the target, and a carrier. In an embodiment, the compound is a multimer and is in an amount effective to bind the target, and a carrier. In an embodiment, the multimer is also present in an amount effective to bind the different moiety. In an embodiment, the carrier is a pharmaceutically acceptable carrier. In an embodiment the carrier is a phosphate-buffered saline. Such a composition may be lyophilized.

This invention provides a method of affecting the activity of a target comprising contacting the target with the composition of one or more of the instant compounds, under conditions such that the compound binds to and affects the activity of the target. In one embodiment, the binding of the composition to the target increases the activity of the target. In one embodiment, the binding of the composition to the target decreases the activity of the target. In one embodiment, the target is an EGF receptor, a HER2 protein, a VEGF receptor, a CD20 antigen, a CD11a, an IgE immunoglobulin, a glycoprotein IIa receptor, a glycoprotein IIIa receptor, a gp40, a gp120, a TNF alpha, or a TNF receptor.

This invention provides a complex comprising the composition of any of the instant compounds and a third stretch of consecutive amino acids, wherein the third stretch of consecutive amino acids is bound to the one of the first or second stretch of consecutive amino acids by one or more bonds. In an embodiment the one or more bonds comprise van der Waals forces. In one embodiment the one or more bonds comprise a hydrogen bond. In one embodiment the one or bonds comprise a covalent bond. In one embodiment the one or bonds comprise a disulfide bond. In an embodiment the at least one bond is a disulfide bond. In an embodiment the disulfide bond is between two non-terminal amino acid residues. In an embodiment the disulfide bond is between two amino acid residues, at least one of which is a non-terminal amino acid residue.

This invention provides a process of making one of the instant compounds comprising:
(a) transfecting a cell with a recombinant nucleic acid which comprises (i) a first portion, the sequence of which is a N-terminal signal sequence, contiguous with (ii) a second portion, the sequence of which encodes a stretch of consecutive amino acids contiguous with (iii) a third portion, the sequence of which encodes a C-terminal intein-containing binding domain, under conditions permitting synthesis of a chimeric polypeptide comprising the stretch of consecutive amino acids contiguous with the C-terminal intein-containing binding domain;
(b) isolating the chimeric polypeptide produced in step (a);
(c) treating the chimeric polypeptide so as to cause thio-mediated cleavage of the C-terminal intein-containing binding domain from the stretch of consecutive amino acids and its replacement with a C-terminal thioester;
(d) treating the product of step (c) to permit the attachment of a cysteine residue to the product so as to form product with a C-terminal cysteine; and
(e) oxidizing the product of step (e) in the presence of another product of step (e) under conditions permitting formation of the compound.

In one embodiment, the recombinant nucleic acid has the sequence set forth in any one of SEQ ID NOs. 1-8. In one embodiment, the C-terminal intein-containing binding domain is an intein-chitin binding domain. In one embodiment, the C-terminal intein-containing binding domain is an Mth RIR1 intein-chitin binding domain. In one embodiment, the chimeric polypeptide is isolated in step b) by affinity chromatography. In one embodiment, the chimeric polypeptide is isolated in step b) by exposure of the product to a chitin-derivatized resin. In one embodiment, the oxidizing conditions permit formation of a disulfide bond between the C-terminal cysteine of each of the products.

This invention provides a compound comprising an independently folding protein domain fused to a second independently folding protein domain by non-peptide bond. This invention provides a compound comprising a first polypeptide chain, comprising a terminal cysteine residue, fused at its S-terminus to a S-terminus of a second polypeptide chain comprising a terminal cysteine residue. This invention provides a compound comprising a first polypeptide chain, comprising a terminal selenocysteine residue, fused at its Se-terminus to a S-terminus of a second polypeptide chain comprising a terminal cysteine residue. This invention provides a compound comprising a first polypeptide chain, comprising a terminal selenocysteine residue, fused at its Se-terminus to a Se-terminus of a second polypeptide chain comprising a terminal selenocysteine residue. This invention provides a multimer comprising two or more identical compounds according to any one of claims 66-69 joined together by at least one bond.

This invention provides a method of making a stretch of consecutive amino acids comprising an N-terminal cysteine comprising:
(a) transfecting a cell with a recombinant nucleic acid which comprises (i) a first portion, the sequence of which encodes a N-terminal signal sequence contiguous with (ii) a second portion, the sequence of which encodes a stretch of consecutive amino acids comprising a N-terminal cysteine residue, under conditions permitting (i) synthesis of a chimeric polypeptide which comprises the N-terminal signal sequence joined by a peptide bond at its C-terminus to the N-terminal cysteine of the stretch of consecutive amino acids and (ii) cleavage of the N-terminal signal sequence from the chimeric polypeptide within the cell so as to produce a stretch of consecutive amino acids comprising an N-terminal cysteine;
(b) recovering the stretch of consecutive amino acids produced in step (a).

In one embodiment of the methods disclosed herein, the stretch of consecutive amino acids is isolated in step (b).

In one embodiment, the stretch of consecutive amino acids comprises an immunoglobulin Fc polypeptide. In one embodiment, the immunoglobulin Fc polypeptide is a human immunoglobulin Fc polypeptide. In one embodiment, the N-terminal cysteine residue is a cys-5 residue of the human immunoglobulin Fc polypeptide. In one embodiment, the cell is a 293 human embryonic cell or a CHO-K1 hamster ovary cell. In one embodiment, the transfection is performed with a plasmid pSA. In one embodiment, N-terminal signal sequence is selected from a protein having a N-terminal cysteine. In one embodiment, the signal peptide is sonic hedgehog, interferon alpha-2 or cholesterol ester transferase. In one embodiment, the stretch of consecutive amino acids is recovered by affinity chromatography. In one embodiment, the cleavage of the chimeric polypeptide within the cell is effected by a cellular signal peptidase.

This invention provides a method of making a stretch of consecutive amino acids comprising an N-terminal cysteine or selenocysteine comprising:
(a) transfecting a cell with a recombinant nucleic acid which comprises (i) a first portion, the sequence of which encodes a N-terminal signal sequence contiguous with (ii) a second portion, the sequence of which encodes a stretch of consecutive amino acids comprising a N-terminal cysteine residue, under conditions permitting (i) synthesis of a chimeric polypeptide comprising the N-terminal signal sequence joined at its C-terminus to the N-terminal cysteine of the Fc polypeptide and (ii) cleavage of the N-terminal signal sequence from the chimeric polypeptide within the cell so as to produce a stretch of consecutive amino acids comprising an N-terminal cysteine;
(b) ligating the N-terminal of the stretch of consecutive amino acids produced in step (a) with a C-terminal of a peptide comprising the amino acid sequence cys-asp-lys-thr-his-thr or with a peptide comprising the amino acid sequence sec-asp-lys-thr-his-thr so as to thereby produce the stretch of consecutive amino acids comprising an N-terminal cysteine or selenocysteine; and
(c) recovering the stretch of consecutive amino acids produced in step (b).

In an embodiment, the stretch of consecutive amino acids comprises an immunoglobulin Fc polypeptide. In an embodiment, the immunoglobulin Fc polypeptide is a human immunoglobulin Fc polypeptide. In an embodiment, the N-terminal cysteine residue is a cys-5 residue of the human immunoglobulin Fc polypeptide. In one embodiment, the N-terminal cysteine residue is a cys-11 residue of the human immunoglobulin Fc polypeptide. In an embodiment, the peptide in step (b) comprises the amino acid sequence cys-asp-lys-thr-his-thr and the stretch of consecutive amino acids produced comprises an N-terminal cysteine. In an embodiment, peptide in step (b) comprises the amino acid sequence sec-asp-lys-thr-his-thr and the stretch of consecutive amino acids produced comprises an N-terminal selenocysteine. In an embodiment, the peptide in step (b) is protected with a N-terminal Msc protecting group prior to ligation. In an embodiment, the cell is a 293 human embryonic cell or a CHO-K1 hamster ovary cell. In an embodiment, the transfection is performed with a plasmid pSA. In an embodiment, the N-terminal signal sequence is selected from a protein having a N-terminal cysteine. In an embodiment, the signal peptide is sonic hedgehog, interferon alpha-2 or cholesterol ester transferase. In an embodiment, the stretch of consecutive amino acids is recovered by affinity chromatography. In an embodiment, the cleavage of the chimeric polypeptide within the cell is effected by a cellular signal peptidase. In embodiments other short peptide sequences with a N-terminal cysteine or selenocysteine are employed in place of those set forth above.

This invention provides process of making a stretch of consecutive amino acids comprising a C-terminal cysteine or a C-terminal selenocysteine, comprising:
(a) transfecting a cell with a recombinant nucleic acid which comprises (i) a first portion, the sequence of which encodes a N-terminal signal sequence, contiguous with (ii) a second portion, the sequence of which encodes a stretch of consecutive amino acids contiguous with (iii) a third portion, the sequence of which encodes a C-terminal intein-containing binding domain, under conditions permitting (i) synthesis of a chimeric polypeptide comprising the N-terminal signal sequence contiguous with the stretch of consecutive amino acids contiguous with the C-terminal intein-containing binding domain and (ii) cleavage of the N-terminal signal sequence from the chimeric polypeptide so as to produce a second chimeric polypeptide having a N-terminal lysine residue and comprising the stretch of consecutive amino acids contiguous with the C-terminal intein-containing binding domain;
(b) isolating the second chimeric polypeptide produced in step (a);
(c) treating the second chimeric polypeptide so as to cause thio-mediated cleavage of the C-terminal intein-containing binding domain from the stretch of consecutive amino acids so as to form a C-terminal thioester;
(d) ligating the product of step (c) with a cysteine residue or selenocysteine residue at its C-terminal so as to form product with a C-terminal cysteine or a C-terminal selenocysteine; and
(e) recovering the product of step (d).

In an embodiment, the stretch of consecutive amino acids contiguous comprises an IgG immunoglobulin Fc polypeptide and an IgG M1 exon. In an embodiment, the IgG immunoglobulin is a human IgG immunoglobulin. In an embodiment, the stretch of consecutive amino acids contiguous comprises a CD4 extracellular domain. In an embodiment, the N-terminal signal sequence is selected from a protein having a N-terminal lysine. In an embodiment, the N-terminal signal sequence is a CD2 T-cell surface glycoprotein or a CD4 T-cell surface glycoprotein. In an embodiment, the cell is a 293 human embryonic cell or a CHO-K1 hamster ovary cell. In an embodiment, the transfection is performed with a plasmid pSA. In an embodiment, the C-terminal intein-containing binding domain is an intein-chitin binding domain. In an embodiment, the C-terminal intein-containing binding domain is an Mth RIR1 intein-chitin binding domain. In an embodiment, the C-terminal intein-containing binding domain is a self-splicing intein-containing binding domain. In an embodiment, the chimeric polypeptide is isolated in step b) by exposure of the product to a chitin-derivatized resin. In an embodiment, the cleavage of the second chimeric polypeptide within the cell is effected by a cellular signal peptidase. In an embodiment, the product of step (c) is ligated with a cysteine residue. In an embodiment, the product of step (c) is ligated with a selenocysteine residue.

This invention provides a process of making a stretch of consecutive amino acids comprising a N-terminal cysteine and a C-terminal cysteine or selenocysteine comprising:

(a) transfecting a cell with a recombinant nucleic acid which comprises (i) a first portion, the sequence of which encodes a N-terminal signal sequence, contiguous with (ii) a second portion, the sequence of which encodes a stretch of consecutive amino acids contiguous with (iii) a third portion, the sequence of which encodes a C-terminal intein-containing binding domain, under conditions permitting (i) synthesis of a chimeric polypeptide comprising the N-terminal signal sequence contiguous with the stretch of consecutive amino acids contiguous with the C-terminal intein-containing binding domain and (ii) cleavage of the N-terminal signal sequence from the chimeric polypeptide so as to produce a second chimeric polypeptide having a N-terminal cysteine residue and comprising the stretch of consecutive amino acids contiguous with the C-terminal intein-containing binding domain;

(b) isolating the second chimeric polypeptide produced in step (a);

(c) treating the second chimeric polypeptide so as to cause thio-mediated cleavage of the C-terminal intein-containing binding domain from the stretch of consecutive amino acids so as to form a C-terminal thioester;

(d) ligating the product of step (c) with a cysteine residue or selenocysteine residue at its C-terminal so as to form product with a C-terminal cysteine or a C-terminal selenocysteine; and (e) recovering the product of step (d).

In an embodiment, the stretch of consecutive amino acids contiguous comprises an IgG immunoglobulin Fc polypeptide and an IgG M1 exon. In an embodiment, the IgG immunoglobulin is a human IgG immunoglobulin. In an embodiment, the N-terminal signal sequence is selected from a protein having a N-terminal cysteine. In an embodiment, the N-terminal cysteine residue is a cys-5 residue of the human immunoglobulin Fc polypeptide. In an embodiment, the N-terminal cysteine residue is a cys-11 residue of the human immunoglobulin Fc polypeptide. In an embodiment, the N-terminal signal is a sonic hedgehog, interferon alpha-2 or cholesterol ester transferase. In an embodiment, the cell is a 293 human embryonic cell or a CHO-K1 hamster ovary cell. In an embodiment, the transfection is performed with a plasmid pSA. In an embodiment, the C-terminal intein-containing binding domain is an intein-chitin binding domain. In an embodiment, the C-terminal intein-containing binding domain is an Mth RIR1 intein-chitin binding domain. In an embodiment, the C-terminal intein-containing binding domain is a self-splicing intein-containing binding domain In an embodiment, the second chimeric polypeptide is isolated in step b) by exposure of the product to a chitin-derivatized resin. In an embodiment, the product is recovered in step e) by affinity chromatography. In an embodiment, the cleavage of the chimeric polypeptide within the cell is effected by a cellular signal peptidase. In an embodiment, the product of step (c) is ligated with a cysteine residue. In an embodiment, the product of step (c) is ligated with a selenocysteine residue.

This invention provides a process of making a stretch of consecutive amino acids comprising a N-terminal cysteine or selenocysteine and a C-terminal cysteine or selenocysteine comprising:

(a) transfecting a cell with a recombinant nucleic acid which comprises a first portion, the sequence of which encodes a N-terminal signal sequence, contiguous with a second portion, the sequence of which encodes a stretch of consecutive amino acids contiguous with (iii) a third portion, the sequence of which encodes a C-terminal intein-containing binding domain, under conditions permitting (i) synthesis of a chimeric polypeptide comprising the N-terminal signal sequence contiguous with the stretch of consecutive amino acids contiguous with the C-terminal intein-containing binding domain and (ii) cleavage of the N-terminal signal sequence from the chimeric polypeptide so as to produce a second chimeric polypeptide having a N-terminal cysteine residue and comprising the stretch of consecutive amino acids contiguous with the C-terminal intein-containing binding domain;

(b) isolating the second chimeric polypeptide produced in step (a);

(c) (i) ligating the N-terminal of the stretch of consecutive amino acids produced in step (a) with a C-terminal of a peptide comprising the amino acid sequence cys-asp-lys-thr-his-thr or with a peptide Comprising the amino acid sequence sec-asp-lys-thr-his-thr so as to thereby produce the stretch of consecutive amino acids comprising a N-terminal cysteine or a N-terminal selenocysteine, respectively;

(ii) treating the chimeric polypeptide so as to cause thio-mediated cleavage of the C-terminal intein-containing binding domain from the stretch of consecutive amino acids and its replacement with a C-terminal thioester;

(iii) ligating the product of step (c) with a cysteine residue or selenocysteine residue at its C-terminal so as to form product with a C-terminal cysteine pr with a C-terminal selenocysteine; and (d) recovering the product of step (c)(iii).

In an embodiment, the stretch of consecutive amino acids contiguous comprises an IgG immunoglobulin Fc polypeptide and an IgG M1 exon. In an embodiment, the IgG immunoglobulin is a human IgG immunoglobulin. In an embodiment, the N-terminal signal sequence is selected from a protein having a N-terminal cysteine. In an embodiment, the N-terminal cysteine residue is a cys-11 residue of the human immunoglobulin Fc polypeptide. In an embodiment, N-terminal signal sequence is selected from a protein having a N-terminal cysteine. In an embodiment, the N-terminal signal is a sonic hedgehog, interferon alpha-2 or cholesterol ester transferase. In an embodiment, the cell is a 293 human embryonic cell or a CHO-K1 hamster ovary cell. In an embodiment, the transfection is performed with a plasmid pSA. In an embodiment, the C-terminal intein-containing binding domain is an intein-chitin binding domain. In an embodiment, the C-terminal intein-containing binding domain is an Mth RIR1 intein-chitin binding domain. In an embodiment, the chimeric polypeptide is isolated in step (b) by exposure of the product to a chitin-derivatized resin.

In an embodiment, the immunoglobulin Fc polypeptide is a human immunoglobulin Fc polypeptide. In an embodiment, the N-terminal cysteine residue of the Fc polypeptide is a cys-11 residue. In an embodiment, the peptide in step (c) comprises the amino acid sequence cys-asp-lys-thr-his-thr and the stretch of consecutive amino In an embodiment, the peptide in step (c)(i) comprises the amino acid sequence sec-asp-lys-thr-his-thr and the stretch of consecutive amino acids produced comprises an N-terminal selenocysteine. In an embodiment, the peptide in step (c) is protected with a N-terminal Msc protecting group prior to ligation. In an embodiment, in the cell is a 293 human embryonic cell or a CHO-K1 hamster ovary cell. In an embodiment, the transfection is performed with a plasmid pSA. In an embodiment, the N-terminal signal sequence is selected from a protein having a N-terminal cysteine. In an embodiment, the signal peptide is sonic hedgehog, interferon alpha-2 or cholesterol ester transferase. In an embodiment, in the stretch of consecutive amino acids is recovered by affinity chromatography.

In an embodiment, step (c) of this instant method is performed in the order step (c)(i); step (c)(ii); step (c)(iii). In an embodiment, step (c) is performed in the order step (c)(ii); step (c)(iii); step (c)(i).

This invention provides a process for making a compound comprising contacting a stretch of consecutive amino acids, each of which is joined to the preceding amino acid by a peptide bond and the sequence of which comprises a binding site for a target with a second stretch of consecutive amino acids, each of which is joined to the preceding amino acid by a peptide bond and the sequence of which is identical to the sequence of the first stretch of consecutive amino acids and which comprises an identical binding site for the target, wherein each of the first stretch of amino acids and the second stretch of amino acids has at a predefined end thereof a cysteine residue or a selenocysteine residue, under reducing conditions so as to make the compound.

This invention provides a process for making a compound comprising contacting a stretch of consecutive amino acids, each of which is joined to the preceding amino acid by a peptide bond and the sequence of which comprises a binding site for a target with a second stretch of consecutive amino acids, each of which is joined to the preceding amino acid by a peptide bond and the sequence of which is different to the sequence of the first stretch of consecutive amino acids and which comprises an identical binding site for the target, wherein each of the first stretch of amino acids and the second stretch of amino acids has at a predefined end thereof a cysteine residue or a selenocysteine residue, under reducing conditions so as to make the compound.

In an embodiment of the instant processes, the reducing conditions do not denature the stretches of consecutive amino acids. In an embodiment, the reducing conditions comprise exposing the stretches of consecutive amino acids to a buffer comprising Tris-HCL and mercaptoethanol. In an embodiment, the buffer is between pH 7.6 and 8.4. In an embodiment, the buffer is pH 8. In an embodiment, the method further comprises exchanging the product into oxidation buffer. In an embodiment, the stretches of consecutive amino acids comprises a CD4 extracellular domain. In an embodiment, the stretches of consecutive amino acids comprises a sequence of an immunoglobulin Fc polypeptide. In an embodiment, the immunoglobulin is a human immunoglobulin.

In embodiments, the transfected cells of the instant methods are grown under conditions suitable to permit expression of the polypeptide.

In an embodiment a compound is provided comprising a first stretch of consecutive amino acids, each of which is joined to the preceding amino acid by a peptide bond and the sequence of which comprises a binding site for a target; and a second stretch of consecutive amino acids, each of which is joined to the preceding amino acid by a peptide bond and the sequence of which is identical to the sequence of the first stretch of consecutive amino acids and which comprises an identical binding site for the target; wherein each of the first stretch of amino acids and the second stretch of amino acids has at a predefined end thereof, independently, a natural amino acid or non-natural amino having a linear aliphatic side-chain acid comprising a sulfur (S) or a selenium (Se) and wherein such sulfur (S) or a selenium (Se) are joined by a bond having the structure:

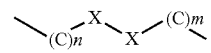

wherein each X is a sulfur (S) or a selenium (Se) and each (C) represents a carbon of the linear aliphatic side-chain of one of such natural or non-natural amino acid and wherein n and m are, independently, 2, 3, 4, 5, 6, 7, 8, 9, or 10.

In an embodiment, the natural amino acid is homocysteine of homoselenocysteine. In an embodiment, the first stretch and second stretch of amino acids have a homocysteine at the predefined end thereof. In an embodiment, the first stretch and second stretch of amino acids have a homoselenocysteine at the predefined end thereof. In an embodiment, the first stretch and second stretch of amino acids have a homocysteine at the predefined end thereof. In an embodiment, the predefined end is a C-terminus.

A compound is provided which comprises a first stretch of consecutive amino acids, each of which is joined to the preceding amino acid by a peptide bond and the sequence of which comprises a binding site for a target; and a second stretch of consecutive amino acids, each of which is joined to the preceding amino acid by a peptide bond and the sequence of which is different from the sequence of the first stretch of consecutive amino acids and which comprises a binding site for a different moiety; wherein each of the first stretch of amino acids and the second stretch of amino acids has at a predefined end thereof, independently, a natural amino acid or non-natural amino having a linear aliphatic side-chain acid comprising a sulfur (S) or a selenium (Se) and wherein such sulfur (S) or a selenium (Se) are joined by a bond having the structure:

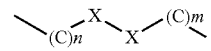

wherein each X may be the same or different and represents a sulfur (S) or a selenium (Se) and each (C) represents a carbon of the linear aliphatic side-chain of one of such natural or non-natural amino acid and wherein n and m are, independently, 1, 2, 3, 4, 5, 6, 7, 8, 9, or 10.

In an embodiment, the natural amino acid is homocysteine of homoselenocysteine. In an embodiment, the first stretch and second stretch of amino acids have a homocysteine at the predefined end thereof. In an embodiment, the first stretch and second stretch of amino acids have a homoselenocysteine at the predefined end thereof. In an embodiment, the first stretch and second stretch of amino acids have a homocysteine at the predefined end thereof. In an embodiment, the predefined end is a C-terminus.

A method is provided of producing a protein which comprises a first polypeptide contiguous with an intein, which intein is contiguous with a second polypeptide comprising a binding domain, the method comprising transfecting an animal cell with a nucleic acid, which nucleic acid comprises (i) a first portion which encodes the polypeptide contiguous with (ii) a second portion which encodes the intein, contiguous with a and the third portion of which encodes the binding domain, under conditions such that the animal cell expresses and secretes the protein. In an embodiment, the animal cell is a derived from mammal. In an embodiment, the binding domain is a chitin-binding domain.

A composition is provided comprising a polypeptide attached to a solid surface through a terminal disulfide bond. In an embodiment, the solid surface is a chip or a bead.

A compound is provided comprising:
a first stretch of consecutive amino acids each of which is joined to the preceding amino acid by a peptide bond and which first stretch of consecutive amino acids comprises an amino acid residue having a chalcogen functional group-containing side chain; and
a second stretch of consecutive amino acids, comprising at least 100 amino acids, each of which is joined to the preceding amino acid by a peptide bond, wherein at least consecutive amino acids of the second stretch of consecutive amino acids have a sequence identical to portion of a human immunoglobulin constant region polypeptide, and wherein the second stretch of consecutive amino acids comprises an amino acid residue having a chalcogen functional group-containing side chain at a predefined terminus thereof,
wherein said amino acid residue having a chalcogen functional group-containing side chain of the first stretch of consecutive amino acids and said amino acid residue having a chalcogen functional group-containing side chain of the second stretch of consecutive amino acids are joined by a bond having the structure:

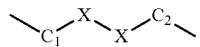

wherein each X represents, independently, a chalcogen, and wherein $C_1$ represents a side chain carbon of the amino acid residue having a chalcogen functional group-containing side chain of the first stretch of consecutive amino acids and $C_2$ represents a side chain carbon of the second stretch of consecutive amino acids.

In embodiments at least wherein at least 91, 92, 93, 94, 95, 96, 97, 98, 99 or 100 consecutive amino acids of the second stretch of consecutive amino acids have a sequence identical to portion of a human immunoglobulin constant region polypeptide.

In an embodiment of the compound, at least one of $C_1$ and $C_2$ is a beta carbon of amino acid. In an embodiment of the compound the bond has the structure:

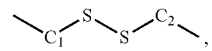

wherein S is sulfur. In an embodiment of the compound the bond has the structure:

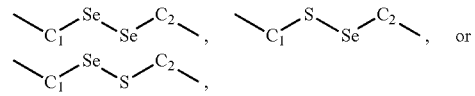

wherein S is sulfur and Se is selenium.

In an embodiment of the compound the amino acid residue having a chalcogen functional group-containing side chain at the predefined terminus of the second stretch of amino acids is a cysteine. In an embodiment of the compound the amino acid residue having a chalcogen functional group-containing side chain at the predefined terminus of the second stretch of amino acids is a selenocysteine, homocysteine or homoseleneocysteine. In an embodiment of the compound the amino acid residue having a chalcogen functional group-containing side chain of the first stretch of consecutive amino acids is a cysteine. In an embodiment of the compound the amino acid residue having a chalcogen functional group-containing side chain of the first stretch of amino acids is a selenocysteine, homocysteine or homoseleneocysteine. In an embodiment of the compound the amino acid residue having a chalcogen functional group-containing side chain of the first stretch of consecutive amino acids is a terminal residue.

In an embodiment, the amino acid residue having a chalcogen functional group-containing side chain of the first stretch of consecutive amino acids is a penultimate, antepenultimate, or pre-antepenultimate terminal residue.

In an embodiment, the second stretch of consecutive amino acids has a sequence identical to a human immunoglobulin constant region. In an embodiment, the second stretch of consecutive amino acids is a portion of a human immunoglobulin constant region. In an embodiment, the first stretch of consecutive amino acids has a sequence identical to a human immunoglobulin constant region.

In an embodiment, the human immunoglobulin constant region polypeptide is a human IgG1, human IgG2, human IgG3, or human IgG4. A compound is provided wherein the side chain of at least one of amino acid residues having a chalcogen functional group-containing side chain comprises a C1-C10 alkylene.

A composition is provided comprising two of the instant compounds bonded together via at least one disulfide bond between the second stretch of consecutive amino acids of each of the compounds.

A composition comprising a polypeptide is provided comprising consecutive amino acids having the sequence set forth in one of SEQ ID NOS:35 through 46, or having the sequence set forth in one of SEQ ID NOS:53 through 67, or having the sequence set forth in one of SEQ ID NOS:74 through 82, or having the sequence set forth in one of SEQ ID NOS:89 through 97, wherein the polypeptide does not consist of a naturally-occurring immunoglobulin polypeptide, including enzyme-cleaved fragments thereof.

A composition comprising a polypeptide is provided consisting of consecutive amino acids having the sequence set forth in one of SEQ ID NOS:35 through 46, or having the sequence set forth in one of SEQ ID NOS:53 through 67, or having the sequence set forth in one of SEQ ID NOS:74 through 82, or having the sequence set forth in one of SEQ ID NOS:89 through 97.

A composition comprising the instant polypeptide is provided and a carrier. In an embodiment of the compound, the carrier is phosphate-buffered saline.

A composition is provided comprising two of the instant independently chosen polypeptides, joined by a non-peptide bond. In one embodiment the bond is a di-chalcogenide bond. In one embodiment the bond is a disulfide bond.

A composition comprising two of the instant polypeptides bonded together via at least one disulfide bond between the two polypeptides is provided.

A composition is provided comprising a polypeptide is provided consisting of consecutive amino acids having a sequence identical to a portion of the sequence set forth in SEQ ID NO:44, SEQ ID NO:64, SEQ ID NO:81 or SEQ ID NO:96, wherein at least one of the terminal residues of the polypeptide has a chalcogen functional group-containing side chain.

In an embodiment of the compound the terminal residue having a chalcogen functional group-containing side chain is a cysteine or analog thereof.

The various N-terminal signal sequences, plasmids, expression vecots, recombinant nucleic acids, stretches of consecutive amino acids, intein binding domains, cell types, recovery/isolation methods, etc set forth hereinabove are non-limiting examples, further of which are set forth in the Examples below.

Definition of Terms

Stretch of consecutive amino acids: a plurality of amino acids arranged in a chain, each of which is joined to a preceding amino acid by a peptide bond, excepting that the first amino acid in the chain is not joined to a preceding amino acid. The amino acids of the chain may be naturally or non-naturally occurring, or may comprise a mixture thereof. The amino acids, unless otherwise indicated, may be genetically encoded, naturally-occurring but not genetically encoded, or non-naturally occurring, and any selection thereof.

In an embodiment, a stretch of consecutive amino acids has biological activity, including, but not limited to, target-binding activity or an immunoeffector activity, which biological activity is retained on the bonding of the stretch of consecutive amino acids to another stretch of consecutive amino acids by an —X—X— bond (e.g. —S—S—, —S—Se—, —Se—Se—, or —Se—S— bond). A "segment of consecutive amino acids" is an alternative description of "a stretch of amino acids".

N-terminal amino acid residue: the terminal residue of a stretch of two or more consecutive amino acids having a free α-amino (NH$_2$) functional group, or a derivative of an α-amino (NH$_2$) functional group.

N-terminus: the free α-amino (NH$_2$) group (or derivative thereof) of a N-terminal amino acid residue.

C-terminal amino acid residue: the terminal residue of a stretch of two or more consecutive amino acids having a free α-carboxyl (COOH) functional group, or a derivative of a α-carboxyl (COOH) functional group.

C-terminus: the free α-carboxyl (COOH) group (or derivative thereof) of a C-terminal amino acid residue.

S-terminal cysteine residue: a cysteine which is the N- and/or C-terminal residue(s) of a stretch of consecutive amino acids, and which has a free β-sulfhydryl (SH) functional group, or a derivative of a β-sulfhydryl (SH) functional group.

S-terminus: the free β-sulfhydryl (SH) group (or derivative thereof) of a S-terminal cysteine residue.

Se-terminal selenocysteine residue: a selenocysteine which is the N- and/or C-terminal residue(s) of a stretch of consecutive amino acids, and which has a free β-selenohydryl (SeH) functional group, or a derivative of a β-selenohydryl (SeH) functional group.

Se-terminus: the free β-selenohydryl (SeH) group (or derivative thereof) of a Se-terminal selenocysteine residue.

X-terminal amino acid residue: a cysteine (or cysteine derivative) or homocysteine (or homocysteine derivative), selenocysteine (or selenocysteine derivative) or homoselenocysteine (or homoselenocysteine derivative), which is the N- and/or C-terminal residue(s) of a stretch of consecutive amino acids, and which has a free β-sulfhydryl (SH) or β-selenohydryl (SeH) functional group, respectively, or a sulfur-containing or selenium-containing derivative thereof.

X-terminus: the free β-sulfhydryl (SH) or β-selenohydryl (SeH) group of a S-terminal cysteine/cysteine derivative residue or of a Se-terminal selenocysteine/selenocysteine derivative residue, respectively. In addition, an X-terminus can be the free β-sulfhydryl (SH) or β-selenohydryl (SeH) group of a S-terminal homocysteine residue or Se-terminal homoselenocysteine residue.

Target: an entity which binds to a discrete selection of a stretch of consecutive amino acids or a portion of a tertiary structure thereof and includes, but is not limited to, receptors, carrier proteins, hormones, cellular adhesive proteins, tissue-specific adhesion factors, growth factors, and enzymes. Specific examples of targets include a human EGF receptor, a HER2 protein, a VEGF receptor, a human CD20 antigen, a human CD11a, a human IgE immunoglobulin, a human glycoprotein IIa receptor, a human glycoprotein IIIa receptor, a human TNF alpha, and a TNF receptor.

A "bond", unless otherwise specified, or contrary to context, is understood to include a covalent bond, a dipole-dipole interaction such as a hydrogen bond, and intermolecular interactions such as van der Waals forces.

A "Signal Sequence" is a short (3-60 amino acids long) peptide chain that directs the post-translational transport of a polypeptide.

"Amino acid" as used herein, in one embodiment, means a L or D isomer of the genetically encoded amino acids, i.e. isoleucine, alanine, leucine, asparagine, lysine, aspartate, methionine, cysteine, phenylalanine, glutamate, threonine, glutamine, tryptophan, glycine, valine, praline, arginine, serine, histidine, tyrosine, selenocysteine, pyrrolysine and also includes homocysteine and homoselenocysteine.

Other examples of amino acids include an L or D isomer of taurine, gaba, dopamine, lanthionine, 2-aminoisobutyric acid, dehydroalanine, ornithine and citrulline, as well as non-natural homologues and synthetically modified forms thereof including amino acids having alkylene chains shortened or lengthened by up to two carbon atoms, amino acids comprising optionally substituted aryl groups, and amino acids comprising halogenated groups, including halogenated alkyl and aryl groups as well as beta or gamma amino acids, and cyclic analogs.

Due to the presence of ionizable amino and carboxyl groups, the amino acids in these embodiments may be in the form of acidic or basic salts, or may be in neutral forms. Individual amino acid residues may also be modified by oxidation or reduction. Other contemplated modifications include hydroxylation of proline and lysine, phosphorylation of hydroxyl groups of seryl or threonyl residues, and methylation of the alpha-amino groups of lysine, arginine, and histidine side chains.

Covalent derivatives may be prepared by linking particular functional groups to the amino acid side chains or at the N- or C-termini.

"Chalcogen" as used herein is limited to sulfur, selenium, tellurium and polonium only, i.e. as used herein, "chalcogen" excludes oxygen and ununhexium.

"Chalcogen functional group containing side chain" as used herein is an amino acid residue side chain containing a terminally reactive non-oxygen, non-ununhexium chalcogen atom. By way of non-limiting example, an amino acid having a chalcogen functional group containing side chain would be cysteine, selenocysteine, homocysteine etc., but would not include methionine, for example, which contains a chalcogen atom (S), but not a terminally reactive chalcogen atom.

Compounds comprising amino acids with R-group substitutions are within the scope of the invention. It is understood that substituents and substitution patterns on the compounds of the instant invention can be selected by one of ordinary skill in the art to provide compounds that are chemically stable from readily available starting materials.

"Natural amino acid" as used herein means a L or D isomer of the genetically encoded amino acids, i.e. isoleucine, alanine, leucine, asparagine, lysine, aspartate, methionine, cysteine, phenylalanine, glutamate, threonine, glutamine, tryptophan, glycine, valine, proline, arginine, serine, histidine, tyrosine, selenocysteine, pyrrolysine and homocysteine and homoselenocysteine.

"Non-natural amino acid" as used herein means a chemically modified L or D isomer of isoleucine, alanine, leucine, asparagine, lysine, aspartate, methionine, cysteine, phenylalanine, glutamate, threonine, glutamine, tryptophan, glycine, valine, proline, arginine, serine, histidine, tyrosine, selenocysteine, pyrrolysine, homocysteine, homoselenocysteine, taurine, gaba, dopamine, lanthionine, 2-aminoisobutyric acid, dehydroalanine, ornithine or citrulline, including cysteine and selenocysteine derivatives having $C_3$-$C_{10}$ aliphatic side chains between the alpha carbon and the S or Se. In one embodiment the aliphatic side chain is an alkylene. In another embodiment, the aliphatic side chain is an alkenylene or alkynylene.

In addition to the stretches of consecutive amino acid sequences described herein, it is contemplated that variants thereof can be prepared by introducing appropriate nucleotide changes into the encoding DNA, and/or by synthesis of the desired consecutive amino acid sequences. Those skilled in the art will appreciate that amino acid changes may alter post-translational processes of the stretches of consecutive amino acids described herein when expression is the chosen method of synthesis (rather than chemical synthesis for example), such as changing the number or position of glycosylation sites or altering the membrane anchoring characteristics.

Variations in the sequences described herein, can be made, for example, using any of the techniques and guidelines for conservative and non-conservative mutations set forth, for instance, in U.S. Pat. No. 5,364,934. Variations may be a substitution, deletion or insertion of one or more codons encoding the consecutive amino acid sequence of interest that results in a change in the amino acid sequence as compared with the native sequence. Optionally the variation is by substitution of at least one amino acid with any other amino acid in one or more of the domains. Guidance in determining which amino acid residue may be inserted, substituted or deleted without adversely affecting the desired activity may be found by comparing the sequence with that of homologous known protein molecules and minimizing the number of amino acid sequence changes made in regions of high homology. Amino acid substitutions can be the result of replacing one amino acid with another amino acid having similar structural and/or chemical properties, such as the replacement of a leucine with a serine, i.e., conservative amino acid replacements. Insertions or deletions may optionally be in the range of about 1 to 5 amino acids. The variation allowed may be determined by systematically making insertions, deletions or substitutions of amino acids in the sequence and testing the resulting variants for activity exhibited by the full-length or mature native sequence. It is understood that any terminal variations are made within the context of the invention disclosed herein.

Amino acid sequence variants of the binding partner are prepared with various objectives in mind, including increasing the affinity of the binding partner for its ligand, facilitating the stability, purification and preparation of the binding partner, modifying its plasma half life, improving therapeutic efficacy, and lessening the severity or occurrence of side effects during therapeutic use of the binding partner.

Amino acid sequence variants of these sequences are also contemplated herein including insertional, substitutional, or deletional variants. Such variants ordinarily can prepared by site-specific mutagenesis of nucleotides in the DNA encoding the target-binding monomer, by which DNA encoding the variant is obtained, and thereafter expressing the DNA in recombinant cell culture. Fragments having up to about 100-150 amino acid residues can also be prepared conveniently by in vitro synthesis. Such amino acid sequence variants are predetermined variants and are not found in nature. The variants exhibit the qualitative biological activity (including target-binding) of the nonvariant form, though not necessarily of the same quantitative value. While the site for introducing an amino acid sequence variation is predetermined, the mutation per se need not be predetermined. For example, in order to optimize the performance of a mutation at a given site, random or saturation mutagenesis (where all 20 possible residues are inserted) is conducted at the target codon and the expressed variant is screened for the optimal combination of desired activities. Such screening is within the ordinary skill in the art.

Amino acid insertions usually will be on the order of about from 1 to 10 amino acid residues; substitutions are typically introduced for single residues; and deletions will range about from 1 to 30 residues. Deletions or insertions preferably are made in adjacent pairs, i.e. a deletion of 2 residues or insertion of 2 residues. It will be amply apparent from the following discussion that substitutions, deletions, insertions or any combination thereof are introduced or combined to arrive at a final construct.

In an aspect, the invention concerns a compound comprising a stretch of consecutive amino acids having at least about 80% sequence identity, preferably at least about 81% sequence identity, more preferably at least about 82% sequence identity, yet more preferably at least about 83% sequence identity, yet more preferably at least about 84% sequence identity, yet more preferably at least about 85% sequence identity, yet more preferably at least about 86% sequence identity, yet more preferably at least about 87% sequence identity, yet more preferably at least about 88% sequence identity, yet more preferably at least about 89% sequence identity, yet more preferably at least about 90% sequence identity, yet more preferably at least about 91% sequence identity, yet more preferably at least about 92% sequence identity, yet more preferably at least about 93% sequence identity, yet more preferably at least about 94% sequence identity, yet more preferably at least about 95% sequence identity, yet more preferably at least about 96% sequence identity, yet more preferably at least about 97% sequence identity, yet more preferably at least about 98% sequence identity and yet more preferably at least about 99% sequence identity to an amino acid sequence disclosed in the specification, a figure, a SEQ ID NO. or a sequence listing of the present application.

The % amino acid sequence identity values can be readily obtained using, for example, the WU-BLAST-2 computer program (Altschul al., Methods in Enzymology 266:460-480 (1996)).

Fragments of native sequences are provided herein. Such fragments may be truncated at the N-terminus or C-terminus, or may lack internal residues, for example, when compared with a full length native protein. Again, it is understood that any terminal variations are made within the context of the invention disclosed herein. Certain fragments lack amino acid residues that are not essential for a desired biological activity of the sequence of interest.

Any of a number of conventional techniques may be used. Desired peptide fragments or fragments of stretches of consecutive amino acids may be chemically synthesized. An alternative approach involves generating fragments by enzymatic digestion, e.g. by treating the protein with an enzyme known to cleave proteins at sites defined by particular amino acid residues, or by digesting the DNA with suitable restriction enzymes and isolating the desired fragment. Yet another suitable technique involves isolating and amplifying a DNA fragment encoding a desired polypeptide/sequence fragment, by polymerase chain reaction (PCR). Oligonucleotides that define the desired termini of the DNA fragment are employed at the 5' and 3' primers in the PCR.

In particular embodiments, conservative substitutions of interest are shown in Table 1 under the heading of preferred substitutions. If such substitutions result in a change in biological activity, then more substantial changes, denominated exemplary substitutions in Table 1, or as further described below in reference to amino acid classes, are introduced and the products screened.

TABLE 1

| Original | Exemplary | Preferred |
|---|---|---|
| Ala (A) | val; leu; ile | val |
| Arg (R) | lys; gln; asn | lys |
| Asn (N) | gln; his; lys; arg | gln |
| Asp (D) | glu | glu |
| Cys (C) | ser | ser |
| Gln (Q) | asn | asn |
| Glu (E) | asp | asp |
| Gly (G) | pro; ala | ala |
| His (H) | asn; gln; lys; arg | arg |
| Ile (I) | leu; val; met; ala; phe; norleucine | leu |
| Leu (L) | norleucine; ile; val; met; ala; phe | ile |
| Lys (K) | arg; gln; asn | arg |
| Met (M) | leu; phe; ile | leu |
| Phe (F) | leu; val; ile; ala; tyr | leu |
| Pro (P) | ala | ala |
| Ser (S) | thr | thr |
| Thr (T) | ser | ser |
| Trp (W) | tyr; phe | tyr |
| Tyr (Y) | trp; phe; thr; ser | phe |
| Val (V) | ile; leu; met; phe; ala; norleucine | leu |

Substantial modifications in function or immunological identity of the sequence are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. Naturally occurring residues are divided into groups based on common side-chain properties:

(1) hydrophobic: norleucine, met, ala, val, leu, ile;
(2) neutral hydrophilic: cys, ser, thr;
(3) acidic: asp, glu;
(4) basic: asn, gln, his, lys, arg;
(5) residues that influence chain orientation: gly, pro;
(6) aromatic: trp, tyr, phe.

Non-conservative substitutions will entail exchanging a member of one of these classes for another class. Such substituted residues also may be introduced into the conservative substitution sites or, more preferably, into the remaining (non-conserved) sites.

The variations can be made using methods known in the art such as oligonucleotide-mediated (site-directed) mutagenesis, alanine scanning, and PCR mutagenesis. Site-directed mutagenesis (Carter et al., Nucl. Acids Res., 13:4331 (1986); Zoller et al., Nucl. Acids Res., 10:6487 (1987)), cassette mutagenesis (Wells et al., Gene, 34:315 (1985)), restriction selection mutagenesis (Wells et al., Philos. Trans. R. Soc. London SerA, 317:415 (1986)) or other known techniques can be performed on the cloned DNA to produce the variant DNA.

Scanning amino acid analysis can also be employed to identify one or more amino acids along a contiguous sequence. Among the preferred scanning amino acids are relatively small, neutral amino acids. Such amino acids include alanine, glycine, serine, and cysteine. Alanine is typically a preferred scanning amino acid among this group because it eliminates the side-chain beyond the beta-carbon and is less likely to alter the main-chain conformation of the variant (Cunningham and Wells, Science, 244:1081-1085 (1989)). Alanine is also typically preferred because it is the most common amino acid. Further, it is frequently found in both buried and exposed positions (Creighton, The Proteins, (W.H. Freeman & Co., N.Y.); Chothia, J. Mol. Biol., 150:1 (1976)). If alanine substitution does not yield adequate amounts of variant, an isoteric amino acid can be used.

Covalent modifications: The stretches of consecutive amino acids may be covalently modified. One type of covalent modification includes reacting targeted amino acid residues with an organic derivatizing agent that is capable of reacting with selected side chains or the N- or C-terminal residues that are not involved in an -x-x-bond. Derivatization with bifunctional agents is useful, for instance, for crosslinking to a water-insoluble support matrix or surface for use in the method for purifying anti-sequence of interest antibodies, and vice-versa. Commonly used crosslinking agents include, e.g., 1,1-bis(diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate), bifunctional maleimides such as bis-N-maleimido-1,8-octane and agents such as methyl-3-((p-azidophenyl)dithio)propioimidate.

Other modifications include deamidation of glutaminyl and asparaginyl residues to the corresponding glutamyl and aspartyl residues, respectively, hydroxylation of proline and lysine, phosphorylation of hydroxyl groups of seryl or threonyl residues, methylation of the .alpha.-amino groups of lysine, arginine, and histidine side chains (T. E. Creighton, Proteins: Structure and Molecular Properties, W.H.

Freeman & Co., San Francisco, pp. 79-86 (1983)), acetylation of the N-terminal amine, and amidation of any C-terminal carboxyl group.

Another type of covalent modification comprises altering the native glycosylation pattern of the consecutive stretch of amino acids or of a polypeptide. "Altering the native glycosylation pattern" is intended for purposes herein to mean deleting one or more carbohydrate moieties found in amino acid sequences (either by removing the underlying glycosylation site or by deleting the glycosylation by chemical and/or enzymatic means), and/or adding one or more glycosylation sites that are not present in the native sequence. In addition, the phrase includes qualitative changes in the glycosylation of the native proteins, involving a change in the nature and proportions of the various carbohydrate moieties present.

Addition of glycosylation sites to the amino acid sequence may be accomplished by altering the amino acid sequence. The alteration may be made, for example, by the addition of, or substitution by, one or more serine or threonine residues to the native sequence (for O-linked glycosylation sites). The amino acid sequence may optionally be altered through changes at the DNA level, particularly by mutating the DNA encoding the amino acid sequence at preselected bases such that codons are generated that will translate into the desired amino acids.

Another means of increasing the number of carbohydrate moieties on the amino acid sequence is by chemical or enzymatic coupling of glycosides to the polypeptide. Such methods are described in the art, e.g., in WO 87/05330 published Sep. 11, 1987, and in Aplin and Wriston, CRC Crit. Rev. Biochem., pp. 259-306 (1981).

Removal of carbohydrate moieties present on the amino acid sequence may be accomplished chemically or enzymatically or by mutational substitution of codons encoding for amino acid residues that serve as targets for glycosylation. Chemical deglycosylation techniques are known in the art and described, for instance, by Hakimuddin, et al., Arch. Biochem. Biophys., 259:52 (1987) and by Edge et al., Anal. Biochem., 118:131 (1981). Enzymatic cleavage of carbohydrate moieties on polypeptides can be achieved by the use of a variety of endo- and exo-glycosidases as described by Thotakura et al., Meth. Enzymol., 138:350 (1987).

Another type of covalent modification comprises linking the amino acid sequence to one of a variety of nonproteinaceous polymers, e.g., polyethylene glycol (PEG), polypropylene glycol, or polyoxyalkylenes, in the manner set forth in U.S. Pat. Nos. 4,640,835; 4,496,689; 4,301,144; 4,670,417; 4,791,192 or 4,179,337, or to a tag polypeptide which provides an epitope to which an anti-tag antibody can selectively bind. Various tag polypeptides and their respective antibodies are well known in the art. Examples include poly-histidine (poly-his) or poly-histidine-glycine (poly-his-gly) tags; the flu HA tag polypeptide and its antibody 12CA5 (Field et al., Mol. Cell. Biol., 8:2159-2165 (1988)); the c-myc tag and the 8F9, 3C7, 6E10, G4, B7 and 9E10 antibodies thereto (Evan et al., Molecular and Cellular Biology, 5:3610-3616 (1985); and the Herpes Simplex virus glycoprotein D (gD) tag and its antibody (Paborsky et al., Protein Engineering, 3(6):547-553 (1990)). Other tag polypeptides include the Flag-peptide (Hopp et al., BioTechnology, 6:1204-1210 (1988)); the KT3 epitope peptide (Martin et al., Science, 255:192-194 (1992)); an alpha-tubulin epitope peptide (Skinner et al., J. Biol. Chem., 266:15163-15166 (1991)); and the T7 gene 10 protein peptide tag (Lutz-Freyermuth et al., Proc. Natl. Acad. Sci. USA, 87:6393-6397 (1990)).

Salts

Salts of the compounds disclosed herein are within the scope of the invention. As used herein, a "salt" is salt of the instant compounds which has been modified by making acid or base salts of the compounds.

Pharmaceuticals

The salt can be pharmaceutically acceptable. Examples of pharmaceutically acceptable salts include, but are not limited to, mineral or organic acid salts of basic residues such as amines; alkali or organic salts of acidic residues such as carboxylic acids. The salts can be made using an organic or inorganic acid. Such acid salts are chlorides, bromides, sulfates, nitrates, phosphates, sulfonates, formates, tartrates, maleates, malates, citrates, benzoates, salicylates, ascorbates, and the like. Carboxylate salts are the alkaline earth metal salts, sodium, potassium or lithium.

Pharmaceutically acceptable salts of the compounds disclosed here can be prepared in any conventional manner, for example by treating a solution or suspension of the corresponding free base or acid with one chemical equivalent of a pharmaceutically acceptable acid or base. Conventional concentration or crystallization techniques can be employed to isolate the salts. Illustrative of suitable acids are acetic, lactic, succinic, maleic, tartaric, citric, gluconic, ascorbic, benzoic, cinnamic, fumaric, sulfuric, phosphoric, hydrochloric, hydrobromic, hydroiodic, sulfamic, sulfonic acids such as methanesulfonic, benzene sulfonic, p-toluenesulfonic, and related acids. Illustrative bases are sodium, potassium, and calcium.

The term "pharmaceutically acceptable carrier" is understood to include excipients, carriers or diluents. The particular carrier, diluent or excipient used will depend upon the means and purpose for which the active ingredient is being applied.

The compounds of this invention may be administered alone or in combination with one or more pharmaceutically acceptable carriers, in either single or multiple doses. Suitable pharmaceutical carriers include inert solid diluents or fillers, sterile aqueous solutions and various organic solvents. The pharmaceutical compositions disclosed herein can be readily administered in a variety of dosage forms such as injectable solutions, tablets, powders, lozenges, syrups, and the like. These pharmaceutical compositions can, if desired, contain additional ingredients such as flavorings, binders, excipients and the like. Additionally, lubricating agents such as magnesium stearate, sodium lauryl sulfate and talc may be used for tabletting purposes. Solid compositions of a similar type may also be employed as fillers in soft and hard filled gelatin capsules. Preferred materials for this include lactose or milk sugar and high molecular weight polyethylene glycols. When aqueous suspensions or elixirs are desired for oral administration, the essential active ingredient therein may be combined with various sweetening or flavoring agents, coloring matter or dyes and, if desired, emulsifying or suspending agents, together with diluents such as water, ethanol, propylene glycol, glycerin and combinations thereof.

For parenteral administration, solutions containing a compound of this invention or a pharmaceutically acceptable salt thereof in sterile aqueous solution may be employed. Such aqueous solutions should be suitably buffered if necessary and the liquid diluent first rendered isotonic with sufficient saline or glucose. These particular aqueous solutions are especially suitable for intravenous, intramuscular, subcutaneous and intraperitoneal administration. The sterile aqueous media employed are all readily available by standard techniques known to those skilled in the art.

The final pharmaceutical composition can be processed into a unit dosage form (e.g., powdered or lyophilized in a vial, a solution in a vial, tablet, capsule or sachet) and then packaged for distribution. The processing step will vary depending upon the particular unit dosage form. For example, a tablet is generally compressed under pressure into a desired shape and a capsule or sachet employs a simple fill operation. Those skilled in the art are well aware of the procedures used for manufacturing the various unit dosage forms.

The compositions of this invention may be in a variety of forms. These include, for example, liquid, semi-solid and solid dosage forms, such as liquid solutions (e.g., injectable and infusible solutions), dispersions or suspensions, tablets, pills, powders, liposomes and suppositories. The preferred form depends on the intended mode of administration and therapeutic application. Some compositions are in the form of injectable or infusible solutions. A mode of administration is parenteral (e.g., intravenous, subcutaneous, intraperitoneal, intramuscular). In an embodiment, the compound is administered by intravenous infusion or injection. In another embodiment, the compound is administered by intramuscular or subcutaneous injection.

Therapeutic compositions as contemplated herein typically must be sterile and stable under the conditions of manufacture and storage. The composition can be formulated as a solution, microemulsion, dispersion, liposome, or other ordered structure suitable to high drug concentration. Sterile injectable solutions can be prepared by incorporating the compound in the required amount in an appropriate solvent with one or a combination of ingredients as required, followed by filtered sterilization. Generally, dispersions are prepared by incorporating the active compound into a sterile vehicle that contains a basic dispersion medium and the required other ingredients from those enumerated above. In the case of sterile powders for the preparation of sterile injectable solutions, the preferred methods of preparation are vacuum drying and freeze-drying that yields a powder of the active ingredient plus any additional desired ingredient from a previously sterile-filtered solution thereof. The proper fluidity of a solution can be maintained, for example, by the use of a coating such as lecithin, by the maintenance of the required particle size in the case of dispersion and by the use of surfactants. Prolonged absorption of injectable compositions can be brought about by including in the composition an agent that delays absorption, for example, monostearate salts and gelatin.

In certain embodiments, the active compound may be prepared with a carrier that will protect the compound against rapid release, such as a controlled release formulation, including implants, transdermal patches, and microencapsulated delivery systems. Biodegradable, biocompatible polymers can be used, such as ethylene vinyl acetate, polyanhydrides, polyglycolic acid, collagen, polyorthoesters, and polylactic acid. Many methods for the preparation of such formulations are patented or generally known to those skilled in the art. See, e.g., Sustained and Controlled Release Drug Delivery Systems, J. R. Robinson, ed., Marcel Dekker, Inc., New York, 1978. In certain embodiments, the compounds of the invention may be orally administered, for example, with an inert diluent or an assimilable edible carrier. The compound (and other ingredients, if desired) may also be enclosed in a hard or soft shell gelatin capsule, compressed into tablets, or incorporated directly into the subject's diet. For oral therapeutic administration, the compounds may be incorporated with excipients and used in the form of ingestible tablets, buccal tablets, troches, capsules, elixirs, suspensions, syrups, wafers, and the like. In administering a compound of the invention by other than parenteral administration the compound may be coated with, or co-administered with, a material to prevent its inactivation.

Supplementary active compounds can also be incorporated into the compositions, for example a chemotherapeutic agent, an antineoplastic agent or an anti-tumor agent. IN addition, the compounds of the invention may be coformulated and/or coadministered with one or more additional therapeutic agents. These agents include, without limitation, antibodies that bind other targets (e.g., antibodies that bind one or more growth factors or cytokines, their cell surface receptors), binding proteins, antineoplastic agents, chemotherapeutic agents, anti-tumor agents, antisense oligonucleotides, growth factors. In one embodiment, a pharmaceutical composition of the compounds disclosed herein may comprise one or more additional therapeutic agent.

For therapeutic use, the compositions disclosed here can be administered in various manners, including soluble form by bolus injection, continuous infusion, sustained release from implants, oral ingestion, local injection (e.g. intracardiac, intramuscular), systemic injection, or other suitable techniques well known in the pharmaceutical arts. Other methods of pharmaceutical administration include, but are not limited to oral, subcutaneously, transdermal, intravenous, intramuscular and parenteral methods of administration. Typically, a soluble composition will comprise a purified compound in conjunction with physiologically acceptable carriers, excipients or diluents. Such carriers will be nontoxic to recipients at the dosages and concentrations employed. The preparation of such compositions can entail combining a compound with buffers, antioxidants, carbohydrates including glucose, sucrose or dextrins, chelating agents such as EDTA, glutathione and other stabilizers and excipients. Neutral buffered saline or saline mixed with conspecific serum albumin are exemplary appropriate diluents. The product can be formulated as a lyophilizate using appropriate excipient solutions (e.g., sucrose) as diluents.

Other derivatives comprise the compounds/compositions of this invention covalently bonded to a nonproteinaceous polymer. The bonding to the polymer is generally conducted so as not to interfere with the preferred biological activity of the compound, e.g. the binding activity of the compound to a target. The nonproteinaceous polymer ordinarily is a hydrophilic synthetic polymer, i.e., a polymer not otherwise found in nature. However, polymers which exist in nature and are produced by recombinant or in vitro methods are useful, as are polymers which are isolated from nature. Hydrophilic polyvinyl polymers fall within the scope of this invention, e.g. polyvinylalcohol and polyvinylpyrrolidone. Particularly useful are polyalkylene ethers such as polyethylene glycol, polypropylene glycol, polyoxyethylene esters or methoxy polyethylene glycol; polyoxyalkylenes such as polyoxyethylene, polyoxypropylene, and block copolymers of polyoxyethylene and polyoxypropylene (Pluronics); polymethacrylates; carbomers; branched or unbranched polysaccharides which comprise the saccharide monomers D-mannose, D- and L-galactose, fucose, fructose, D-xylose, L-arabinose, D-glucuronic acid, sialic acid, D-galacturonic acid, D-mannuronic acid (e.g. polymannuronic acid, or alginic acid), D-glucosamine, D-galactosamine, D-glucose and neuraminic acid including homopolysaccharides and heteropolysaccharides such as lactose, amylopectin, starch, hydroxyethyl starch, amylose, dextran sulfate, dextran, dextrins, glycogen, or the polysaccharide subunit of acid mucopolysaccharides, e.g. hyaluronic acid; polymers of sugar alcohols such as polysorbitol and polymannitol; as well as heparon or heparon.

The pharmaceutical compositions of the invention may include a "therapeutically effective amount" or a "prophylactically effective amount" of a compound of the invention. A "therapeutically effective amount" refers to an amount effective, at dosages and for periods of time necessary, to achieve the desired therapeutic result. A therapeutically effective amount of the compound may vary according to factors such as the disease state, age, sex, and weight of the individual. A therapeutically effective amount is also one in which any toxic or detrimental effects of the compound are outweighed by the therapeutically beneficial effects. A "prophylactically effective amount" refers to an amount effective, at dosages and for periods of time necessary, to achieve the desired prophylactic result. Typically, since a prophylactic dose is used in subjects prior to or at an earlier stage of disease, the prophylactically effective amount will be less than the therapeutically effective amount.

Examples of Pharmaceutical Compositions

Non-limiting examples of such compositions and dosages are set forth as follows:

Compositions comprising a compound comprising a stretch of consecutive amino acids which comprises consecutive amino acids having the sequence of bevacizumab (e.g. Avastin) may comprise trehalose dihydrate, sodium phosphate (monobasic, monohydrate), sodium phosphate (dibasic, anhydrous), polysorbate 20, and Water for Injection, USP. The composition may also be lyophilized, to which the water can be added for reconstitution. In an embodiment the composition has a pH of 6.2 or about 6.2. In one embodiment the compound can be administered combination with a chemotherapeutic such as intravenous 5-fluorouracil for treatment of patients with metastatic carcinoma of the colon or rectum. In one embodiment the compound is administered in a dose of between 0.1 and 10 mg/kg given once every 14 days as an IV infusion. In a further embodiment the dose is 5 mg/kg given once every 14 days. In an embodiment the dose is between 1.0 and 2.0 mg/kg given once every 14 days. In an embodiment the dose is between 0.01 and 1.5 mg/kg given once every 14 days. In an embodiment the dose is between 0.001 and 10 mg/kg given once every 1-21 days.

Compositions comprising a compound comprising a stretch of consecutive amino acids which comprises consecutive amino acids having the sequence of trastuzumab (e.g. Herceptin) may comprise trehalose dihydrate, L-histidine HCl, L-histidine, and polysorbate 20, USP. This can be reconstituted with Bacteriostatic Water for Injection (BWFI), USP, or equivalents thereof, containing 1.1% benzyl alcohol as a preservative or equivalents thereof. In an embodiment the composition has a pH of about 6.0. The composition may also be lyophilized, to which the water can be added for reconstitution. In one embodiment the compound can be administered to subjects with metastastic breast cancer whose tumor overexpresses HER2 protein. In an embodiment the subject has received/is receiving chemotherapy. In another embodiment the compound is administered in combination with paclitaxel to subjects with metastatic breast cancer whose tumors overexpress the HER2 protein and who have not received chemotherapy for their metastatic disease. In one embodiment the compound is administered in an initial dose of between 0.1 and 10 mg/kg in a continuous 45-120 minute infusion IV infusion. In a further embodiment the compound is administered in a dose of 4 mg/kg in a 90 minute infusion. In an embodiment a weekly maintenance dose is administered to the subject at a dose of 2 mg/kg in a 30 minute infusion. In an embodiment the compound is administered in a dose of 0.5 to 1.5 mg/kg in a 90 minute infusion. In an embodiment a weekly maintenance dose is administered to the subject at a dose of 0.5-1.0 mg/kg in a 30 minute infusion. In an embodiment the compound is administered in a dose of 0.04 to 0.5 mg/kg in a 90 minute infusion. In an embodiment the compound is administered in a dose of between 0.001 to 10 mg/kg in a 90 minute infusion.

Compositions comprising a compound comprising a stretch of consecutive amino acids which comprises consecutive amino acids having the sequence of rituximab (e.g. Rituxin) may comprise sodium chloride, sodium citrate dihydrate, polysorbate 80, and Water for Injection (USP), or equivalents thereof. In an embodiment the pH of the composition is adjusted to 6.5. The composition may also be lyophilized, to which the water can be added for reconstitution. In one embodiment the compound is administered to a subject for the treatment of relapsed or refractory, low-grade or follicular, CD20-positive, B-cell non-Hodgkin's lymphoma. In one embodiment the compound is administered at a dose of 250-500 mg/m2 IV infusion once weekly for 4 or 8 doses. In a further embodiment the compound is administered at 375 mg/m2 IV infusion once weekly for 4 or 8 doses. In one embodiment the compound is administered at a dose of 150-250 mg/m2 IV infusion once weekly for 4 or 8 doses. In one embodiment the compound is administered at a dose of 1.5 to 5 mg/m2 IV infusion once weekly for 4 or 8 doses. In one embodiment the compound is administered at a dose of between 1.0 and 500 mg/m2 IV infusion once weekly for 4 or 8 doses Compositions comprising a compound comprising a stretch of consecutive amino acids which comprises consecutive amino acids having the sequence of efalizumab (e.g. Raptiva) may comprise sucrose, L-histidine hydrochloride monohydrate, L-histidine and polysorbate 20. Such a composition may be diluted to an appropriate dosage form with sterile non-USP water, or Sterile Water for Injection, USP, or equivalents thereof. The composition may also be lyophilized, to which the water can be added for reconstitution. In one embodiment the compound is administered to a subject for the treatment of chronic moderate to severe plaque psoriasis. Such a subject may be a candidate for systemic therapy or phototherapy. In an embodiment the compound is administered in a single 0.1-1.1 mg/kg subcutaneous (SC) conditioning dose followed by weekly SC doses of 0.8-1.5 mg/kg (maximum single dose not to exceed a total of 250 mg). In a further embodiment the compound is administered in a single 0.7 mg/kg SC conditioning dose followed by weekly SC doses of 1 mg/kg (maximum single dose not to exceed a total of 200 mg). In an embodiment the compound is administered in a single 0.001-1.0 mg/kg subcutaneous (SC) conditioning dose followed by weekly SC doses of 0.008-0.015 mg/kg.

Compositions comprising a compound comprising a stretch of consecutive amino acids which comprises consecutive amino acids having the sequence of omalizumab (e.g. Xolair) may comprise sucrose, L-histidine hydrochloride monohydrate, L-histidine, and polysorbate 20. Such a composition may lyophilized. In an embodiment the composition is diluted to an appropriate dosage form with Sterile Water for Injection, USP, or equivalents thereof. In one embodiment the compound is administered to a subject for the treatment of moderate to severe persistent asthma. In another embodiment the compound is administered to a subject who has a positive skin test or in vitro reactivity to a perennial aeroallergen and whose symptoms are inadequately controlled with inhaled corticosteroids in order to decrease the incidence of asthma exacerbations. In an embodiment the compound is administered at a dose of 100 to 400 mg subcutaneously every 2 or 4 weeks. In a further embodiment the compound is administered at a dose of 150 to 375 mg SC every 2 or 4 weeks. In an embodiment the compound is administered at a dose of 25 to 150 mg subcutaneously every 2 or 4 weeks. In an embodiment the compound is administered at a dose of 1 to 4 mg subcutaneously every 2 or 4 weeks.

Compositions comprising a compound comprising a stretch of consecutive amino acids which comprises consecutive amino acids having the sequence of etanercept (e.g. Enbrel) may comprise mannitol, sucrose, and tromethamine. In an embodiment, the composition is in the form of a lyophilizate. In an embodiment, the composition is reconstituted with, for example, Sterile Bacteriostatic Water for Injection (BWFI), USP (containing 0.9% benzyl alcohol). In an embodiment the compound is administered to a subject for reducing signs and symptoms, inducing major clinical response, inhibiting the progression of structural damage, and improving physical function in subjects with moderately to severely active rheumatoid arthritis. The compound may be initiated in combination with methotrexate (MTX) or used alone. In an embodiment the compound is administered to a subject for reducing signs and symptoms of moderately to severely active polyarticular-course juvenile rheumatoid arthritis in subjects who have had an inadequate response to one or more DMARDs. In an embodiment the compound is administered to a subject for reducing signs and symptoms, inhibiting the progression of structural damage of active arthritis, and improving physical function in subjects with psoriatic arthritis. In an embodiment the compound is administered to a subject for reducing signs and symptoms in subjects with active ankylosing spondylitis. In an embodiment the compound is administered to a subject for the treatment of chronic moderate to severe plaque psoriasis. In an embodiment wherein the subject has rheumatoid arthritis, psoriatic arthritis, or ankylosing spondylitis the compound is administered at 25-75 mg per week given as one or more subcutaneous (SC) injections. In a further embodiment the compound is administered at 50 mg per week in a single SC injection. In an embodiment wherein the subject has plaque psoriasis the compound is administered at 25-75 mg twice weekly or 4 days apart for 3 months followed by a reduction to a maintenance dose of 25-75 mg per week. In a further embodiment the compound is administered at a dose of at 50 mg twice weekly or 4 days apart for 3 months followed by a reduction to a maintenance dose of 50 mg per week. In an embodiment the dose is between 2× and 100× less than the doses set forth herein. In an embodiment wherein the subject has active polyarticular-course JRA the compound may be administered at a dose of 0.2-1.2 mg/kg per week (up to a maximum of 75 mg per week). In a further embodiment the compound is administered at a dose of 0.8 mg/kg per week (up to a maximum of 50 mg per week). In some embodiments the dose is between 2× and 100× less than the doses set forth hereinabove.

Compositions comprising a compound comprising a stretch of consecutive amino acids which comprises consecutive amino acids having the sequence of infliximab (e.g. Remicade) may comprise sucrose, polysorbate 80, monobasic sodium phosphate, monohydrate, and dibasic sodium phosphate, dihydrate. Preservatives are not present in one embodiment. In an embodiment, the composition is in the form of a lyophilizate. In an embodiment, the composition is reconstituted with, for example, Water for Injection (BWFI), USP. In an embodiment the pH of the composition is 7.2 or is about 7.2. In one embodiment the compound is administered is administered to a subject with rheumatoid arthritis in a dose of 2-4 mg/kg given as an intravenous infusion followed with additional similar doses at 2 and 6 weeks after the first infusion then every 8 weeks thereafter. In a further embodiment the compound is administered in a dose of 3 mg/kg given as an intravenous infusion followed with additional similar doses at 2 and 6 weeks after the first infusion then every 8 weeks thereafter. In an embodiment the dose is adjusted up to 10 mg/kg or treating as often as every 4 weeks. In an embodiment the compound is administered in combination with methotrexate. In one embodiment the compound is administered is administered to a subject with Crohn's disease or fistulizing Crohn's disease at dose of 2-7 mg/kg given as an induction regimen at 0, 2 and 6 weeks followed by a maintenance regimen of 4-6 mg/kg every 8 weeks thereafter for the treatment of moderately to severely active Crohn's disease or fistulizing disease. In a further embodiment the compound is administered at a dose of 5 mg/kg given as an induction regimen at 0, 2 and 6 weeks followed by a maintenance regimen of 5 mg/kg every 8 weeks thereafter for the treatment of moderately to severely active Crohn's disease or fistulizing disease. In an embodiment the dose is adjusted up to 10 mg/kg. In one embodiment the compound is administered to a subject with ankylosing spondylitis at a dose of 2-7 mg/kg given as an intravenous infusion followed with additional similar doses at 2 and 6 weeks after the first infusion, then every 6 weeks thereafter. In a further embodiment the compound is administered at a dose of 5 mg/kg given as an intravenous infusion followed with additional similar doses at 2 and 6 weeks after the first infusion, then every 6 weeks thereafter. In one embodiment the compound is administered to a subject with psoriatic arthritis at a dose of 2-7 mg/kg given as an intravenous infusion followed with additional similar doses at 2 and 6 weeks after the first infusion then every 8 weeks thereafter. In a further embodiment the compound is administered at a dose of 5 mg/kg given as an intravenous infusion followed with additional similar doses at 2 and 6 weeks after the first infusion then every 8 weeks thereafter. In an embodiment the compound is administered with methotrexate. In one embodiment the compound is administered to a subject with ulcerative colitis at a dose of 2-7 mg/kg given as an induction regimen at 0, 2 and 6 weeks followed by a maintenance regimen of 2-7 mg/kg every 8 weeks thereafter for the treatment of moderately to severely active ulcerative colitis. In a further embodiment the compound is administered to a subject with ulcerative colitis at a dose of 5 mg/kg given as an induction regimen at 0, 2 and 6 weeks followed by a maintenance regimen of 5 mg/kg every 8 weeks thereafter. In some embodiments the dose is between 2× and 100× less than the doses set forth hereinabove for treating the individual diseases.

Compositions comprising a compound comprising a stretch of consecutive amino acids which comprises consecutive amino acids having the sequence of cetuximab (e.g. Erbitux) may comprise a preservative-free composition including sodium chloride, sodium phosphate dibasic heptahydrate, sodium phosphate monobasic monohydrate. In an embodiment, the composition is in the form of a lyophilizate. In an embodiment, the composition is reconstituted with, for example, Water for Injection, USP. In an embodiment the pH of the composition is in the range of about 7.0 to about 7.4. In one embodiment the compound is administered to a subject for the treatment of EGFR-expressing, metastatic colorectal carcinoma. In another embodiment the compound is used in combination with irinotecan for the treatment in patients who are refractory to irinotecan-based chemotherapy. In an embodiment the compound is administered at a dose of 300-500 mg/m2 as an initial loading dose (first infusion) administered as a 120-minute IV infusion (maximum infusion rate 5 mL/min). In a further embodiment the compound is administered at a dose of 400 mg/m2 as an initial loading dose (first infusion) administered as a 120-minute IV infusion (maximum infusion rate 5 mL/min). In an embodiment the weekly maintenance dose (all other infusions) is 200-300 mg/m2 infused over 60 minutes (maximum infusion rate 5 mL/min). In a further embodiment the weekly maintenance dose (all other infusions) is 250 mg/m2 infused over 60 minutes (maximum infusion rate 5 mL/min). In some embodiments the dose is between 2× and 100× less than the doses set forth hereinabove.

Compositions comprising a compound comprising a stretch of consecutive amino acids which comprises consecutive amino acids having the sequence of abciximab (e.g. Reopro) may comprise, a preservative-free composition including sodium phosphate, sodium chloride and polysorbate 80. In an embodiment, the composition is in the form of a lyophilizate. In an embodiment, the composition is diluted in, or reconstituted with, for example, Water for Injection, USP. In an embodiment the pH of the composition is 7.2 or is about 7.2. In one embodiment, the composition is used as an adjunct to percutaneous coronary intervention (PCI). In such a use the compositions may be administered as an intravenous bolus of 0.15 to 0.35 mg/kg at 10-60 minutes before the start of PCI. In a further embodiment the dose is 0.2 mg/kg. In an embodiment, the bolus is followed by continuous intravenous infusion of 0.1 to 0.15 g/kg/min for up to 12 hours. In a further embodiment the dose is 0.125 g/kg/min for up to 12 hours. In one embodiment, the composition is used as an adjunct to percutaneous coronary intervention (PCI) in subjects suffering from unstable angina. In one embodiment of such a use the compositions may be administered as an intravenous bolus at 0.1 to 0.4 mg/kg before the start of PCI followed by continuous intravenous infusion of 5-15 g/min for up to 24 hours, concluding 1 hour after the PCI. In a further embodiment the composition is administered as an intravenous bolus at 0.25 mg/kg before the start of PCI followed by continuous intravenous infusion of 10 g/min for up to 24 hours, concluding 1 hour after the PCI. In some embodiments the dose is between 2× and 100× less than the doses set forth hereinabove.

In each of the embodiments of the compositions described herein, the compositions, when in the form of a lyophilizate, may be reconstituted with, for example, sterile aqueous solutions, sterile water, Sterile Water for Injections (USP), Sterile Bacteriostatic Water for Injections (USP), and equivalents thereof known to those skilled in the art.

It is understood that in administration of any of the instant compounds, the compound may be administered in isolation, in a carrier, as part of a pharmaceutical composition, or in any appropriate vehicle.

Dosage

It is understood that where a dosage range is stated herein, e.g. 1-10 mg/kg per week, the invention disclosed herein also contemplates each integer dose, and tenth thereof, between the upper and lower limits. In the case of the example given, therefore, the invention contemplates 1.0, 1.1, 1.2, 1.3, 1.4, 1.5, 1.6, 1.7, 1.8, 1.9, 2.0, 2.1, 2.2, 2.3, 2.4 etc. mg/kg up to 10 mg/kg.

In embodiments, the compounds of the present invention can be administered as a single dose or may be administered as multiple doses.

In general, the daily dosage for treating a disorder or condition according to the methods described above will generally range from about 0.01 to about 10.0 mg/kg body weight of the subject to be treated.

Variations based on the aforementioned dosage ranges may be made by a physician of ordinary skill taking into account known considerations such as the weight, age, and condition of the person being treated, the severity of the affliction, and the particular route of administration chosen.

It is also expected that the compounds disclosed will effect cooperative binding with attendant consequences on effective dosages required.

Kits

Another aspect of the present invention provides kits comprising the compounds disclosed herein and the pharmaceutical compositions comprising these compounds. A kit may include, in addition to the compound or pharmaceutical composition, diagnostic or therapeutic agents. A kit may also include instructions for use in a diagnostic or therapeutic method. In a diagnostic embodiment, the kit includes the compound or a pharmaceutical composition thereof and a diagnostic agent. In a therapeutic embodiment, the kit includes the antibody or a pharmaceutical composition thereof and one or more therapeutic agents, such as an additional antineoplastic agent, anti-tumor agent or chemotherapeutic agent.

Subjects

In some embodiments the subject is a human. In an embodiment the subject is 18 years or older. In another embodiment the subject is less than 18 years old.

All combinations of the various elements disclosed herein are within the scope of the invention.

This invention will be better understood by reference to the Experimental Details which follow, but those skilled in the art will readily appreciate that the specific examples detailed are only illustrative of the invention as described more fully in the claims which follow thereafter.

SymmetroAdhesins

This patent specification describes genetic devices which are devices comprising functional stretches of consecutive amino acids joined in a novel manner. Until now, proteins have been genetically engineered to create new functions by virtue of their adopting a novel fixed structure or conformation. In contrast to such previously genetically engineered proteins, the genetic devices disclosed herein comprise two or more distinguishable protein domains that are connected by novel chemical bonds in a manner permitting relative motion to occur between the domains. The relative motion between protein domains constitutes the moving parts of the genetic devices, and the useful work which they are able to thereby carry out. Input energy for this work is provided by the kinetic and rotational energies intrinsic to the protein domains themselves, as well as the energy of mechanical interactions between the protein domains and solvent molecules, and the like.

This disclosure describes "symmetroadhesins", a specific class of genetic devices. Symmetroadhesins comprise two or more chemically-bonded adhesins (independently folding polypeptide binding domains or stretches of consecutive amino acids). These chemically-bonded adhesins are capable of relative motion with respect to one another, resulting in the formation of two or more symmetrically-oriented binding domains useful in binding dimeric ligands, trimeric ligands, tetrameric ligands, and the like, with greatly increased affinity. Symmetroadhesin-Fc hybrid proteins are a particularly useful embodiment of the genetic devices.

The importance of symmetry in the effectiveness of therapeutic proteins is due to the fact that most protein disease targets themselves display such a higher-order symmetric structure. For example, if the disease target consists of two proteins it is said to be a dimer, if it consists of three proteins it is said to be a trimer, and so forth. If a protein therapeutic binds to the protein disease target only on a one-at-a-time basis, then the strength of the binding is typically on the order of the nano-molar range. At this ordinary level of binding, which is typical of present-day therapeutic proteins, it becomes necessary to flood the body with an enormous and wasteful excess of the therapeutic protein relative to the protein disease target (one million-to-one basis).

Each symmetroadhesin is engineered using a simple set of rules that makes proteins into more useful therapeutics by making them more symmetric. For a symmetroadhesin designed to bind to the protein disease target on a two-at-a-time basis, the strength of binding will be on the order of the nano H nano-molar range. Cooperative binding permits such an extraordinary level of binding. At this extraordinary level of binding, it is only necessary to administer much less of the therapeutic protein relative to the protein disease target (one to one basis).

Peptide Bond Chemistry

All proteins consist of one or more polypeptide chains, stretches of consecutive amino acids, each of which is joined to the preceding amino acid by a peptide bond. Due to resonance between the single bond form (—C—N—) and double bond form (—C=N—) which occur in amides, the peptide bond has a significant degree of double bond character (—C=N—$C_\alpha$—C=N—). As a consequence, peptide bonds in proteins are approximately planar. Although the adjoining N—$C_\alpha$ and $C_\alpha$—C bonds are relatively free to rotate, the rigidly of the peptide bond reduces the degrees of freedom of the folded polypeptide chain to the point where it behaves like a single, static object.

Consider a first stretch of N consecutive amino acids and a second stretch of P consecutive amino acids, $AA_1$-[ ]-$AA_n$ and $AA_1$-[ ]-$AA_p$, with the peptide bonding shown in 1:

$$C_{\alpha(1)}-C{=}N-[\ ]-C{=}N-C_{\alpha(N)}\ \&\ C_{\alpha(1)}-C{=}N-[\ ]-C{=}N-C_{\alpha(P)} \qquad 1$$

Joining of the first stretch of consecutive amino acids at its N-terminus by a new peptide bond to the C-terminus of the second stretch of consecutive amino acids will form a chimeric polypeptide, $AA_1$-[ ]-$AA_n$-$AA_{n+1}$-[ ]-$AA_{n+p}$, with the peptide bonding shown in 2:

$$C_{\alpha(1)}-C{=}N-[\ ]-C{=}N-C_{\alpha(N)}-C{=}N-C_{\alpha(N+1)}-C{=}N-[\ ]-C{=}N-C_{\alpha(N+P)} \qquad 2$$

The chimeric polypeptide, like either of its progenitors, is a single stretch of consecutive amino acids, each of which is also joined to the preceding amino acid by a peptide bond. The folded chimeric polypeptide chain will thus also generally behave like a single, static object.

This invention provides for novel protein-like molecules, herein termed genetic devices, which like mechanical devices are dynamic objects with two or more moving parts that are interconnected in a manner to permit relative movement. Each part, or domain, in a genetic device is a stretch of consecutive amino acids, and each interconnection is made by a non-peptide bond joining a predefined end of each stretch of consecutive amino acids. Preferably, the domains in a genetic device are binding domains. Three distinct types of genetic devices are distinguished by the topology of their interconnections as shown in 3, 4, and 5:

$$C_{\alpha(1)}-C{=}N-[\ ]-C{=}N-C_{\alpha(N)}-X_c-X_n-C_{\alpha(N+1)}-C{=}N-[\ ]-C{=}N-C_{\alpha(N+P)} \qquad 3$$

$$C_{\alpha(1)}-C{=}N-[\ ]-C{=}N-C_{\alpha(N)}-X_c-X_c-C_{\alpha(P)}-N{=}C-[\ ]-N{=}C-C_{\alpha(1)} \qquad 4$$

$$C_{\alpha(N)}-N{=}C-[\ ]-N{=}C-C_{\alpha(1)}-X_n-X_n-C_{\alpha(1)}-C{=}N-[\ ]-C{=}N-C_{\alpha(P)} \qquad 5$$

Genetic device with two identical binding domains that are connected at distinct termini (6) have an asymmetric configuration, $$C_{\alpha(1)}-C{=}N-[\ ]-C{=}N-C_{\alpha(N)}-X_c-X_n-C_{\alpha(N+1)}-C{=}N-[\ ]-C{=}N-C_{\alpha(2N)} \qquad 6$$

Genetic device with two identical binding domains that are connected at identical termini (7 and 8) have a configuration with point symmetry, $$C_{\alpha(1)}-C{=}N-[\ ]-C{=}N-C_{\alpha(N)}-X_c-X_c-C_{\alpha(N)}-N{=}C-[\ ]-N{=}C-C_{\alpha(1)} \qquad 7$$

$$C_{\alpha(N)}-N{=}C-[\ ]-N{=}C-C_{\alpha(1)}-X_n-X_n-C_{\alpha(1)}-C{=}N-[\ ]-C{=}N-C_{\alpha(N)} \qquad 8$$

The genetic devices shown in 7 and 8 are herein termed hemi-symmetroadhesins. Although hemi-symmetroadhesins are have structures with point symmetry they are not capable of rotating both their binding domains independently, and thus, they are generally not able to bind symmetrically to more than one binding site in a symmetric target.

This invention also provides protein-like molecules capable of binding symmetrically to two or more binding sites in a symmetric target (i.e., cooperatively). Genetic devices that are capable of binding symmetric targets symmetrically are termed herein symmetroadhesins. Like a human body grasping a oversized, yet symmetric object (e.g., a medicine ball) with two hands instead of one, the ability of symmetroadhesins to bind symmetric targets is generally much greater than proteins.

Symmetroadhesin Subtypes

Tables 2-11 set forth various non-limiting embodiments of different symmetroadhesins. For example, Table 2, describing CD4-symmetroadhesins, shows in the top line the configuration of a CD4 hemi-symmetroadhesin, i.e. a CD4 domain with a C-terminal X-terminus, e.g. a stretch of consecutive amino acids which is a CD4 domain with a C-terminal cysteine or selenosyteine residue bonded through a non-peptide link (for example a cysteine-cysteine disulfide bond or a selenocysteine-selenocysteine diselenide bond) to a second stretch of consecutive amino acids which is a CD4 domain with a C-terminal cysteine or selenosyteine residue bonded through a non-peptide link, generically described as [CD4-Xc-Xc-CD4]. A dimer of the CD4 hemi-symmetroadhesin and a Fc hemisymmetroadhesin to form an immunosymmetroadhesin is set forth in the second row of Table 2, for example, described as $[CD4\text{-}Xc\text{-}Sn\text{-}Fc]_2$. In each of the tables Xc represents a C-terminal X-terminus; Xn a N-terminal X-terminus, Sn a N-terminal cysteine residue

TABLE 2

CD4 Symmetroadhesins

| Stretches of Consecutive Amino Acids | Class | Symmetroadhesin Configuration |
|---|---|---|
| CD4-$X_c$ | hemi- | [CD4-$X_c$-$X_c$-CD4] |
| CD4-$X_c$ + $S_n$-Fc | immuno | [CD4-$X_c$-$S_n$-Fc]$_2$ |
| CD4-$X_c$ + $X_n$-Fc | immuno | [CD4-$X_c$-$X_n$-Fc]$_2$ |
| CD4-$X_c$ + Fc-$X_c$ | immuno | [Fc-$X_c$-$X_c$-CD4]$_2$ |
| CD4-$X_c$ + $S_n$-Fc-$X_c$ | bi- | [CD4-$X_c$-$S_n$-Fc-$X_c$-$X_c$-CD4]$_2$ |
| CD4-$X_c$ + $X_n$-Fc-$X_c$ | bi- | [CD4-$X_c$-$X_n$-Fc-$X_c$-$X_c$-CD4]$_2$ |

TABLE 3

TNR Hemi-Symmetroadhesins

| Stretches of Consecutive Amino Acids | # | Symmetroadhesin Configurations |
|---|---|---|
| TNR$_1$-$X_c$ | 1 | [TNR$_1$-$X_c$-$X_c$-TNR$_1$] |
| TNR$_2$-$X_c$ | 1 | [TNR$_2$-$X_c$-$X_c$-TNR$_2$] |
| TNR$_{Fab}$-$X_c$ | 1 | [TNR$_{Fab}$-$X_c$-$X_c$-TNR$_{Fab}$] |
| TNR$_1$-$X_c$ + TNR$_2$-$X_c$ | 3 | [(TNR$_{1/2}$)-$X_c$-$X_c$-(TNR$_{1/2}$)] |
| TNR$_1$-$X_c$ + TNR$_{Fab}$-$X_c$ | 3 | [(TNR$_{1/Fab}$)-$X_c$-$X_c$-(TNR$_{1/Fab}$)] |
| TNR$_2$-$X_c$ + TNR$_{Fab}$-$X_c$ | 3 | [(TNR$_{2/Fab}$)-$X_c$-$X_c$-(TNR$_{2/Fab}$)] |
| TNR$_1$-$X_c$ + TNR$_2$-$X_c$ + TNR$_{Fab}$-$X_c$ | 6 | [(TNR$_{1/2/Fab}$)-$X_c$-$X_c$-(TNR$_{1/2/Fab}$)] |

TABLE 4

TNR ImmunoSymmetroadhesins

| Stretches of Consecutive Amino Acids | # | Symmetroadhesin Configurations |
|---|---|---|
| TNR$_1$-$X_c$ + $S_n$-Fc | 1 | [TNR$_1$-$X_c$-$S_n$-Fc]$_2$ |
| TNR$_1$-$X_c$ + $X_n$-Fc | 1 | [TNR$_1$-$X_c$-$X_n$-Fc]$_2$ |
| TNR$_1$-$X_c$ + Fc-$X_c$ | 1 | [Fc-$X_c$-$X_c$-TNR$_1$]$_2$ |
| TNR$_2$-$X_c$ + $S_n$-Fc | 1 | [TNR$_2$-$X_c$-$S_n$-Fc]$_2$ |
| TNR$_2$-$X_c$ + $X_n$-Fc | 1 | [TNR$_2$-$X_c$-$X_n$-Fc]$_2$ |
| TNR$_2$-$X_c$ + Fc-$X_c$ | 1 | [Fc-$X_c$-$X_c$-TNR$_2$]$_2$ |
| TNR$_{Fab}$-$X_c$ + $S_n$-Fc | 1 | [TNR$_{Fab}$-$X_c$-$S_n$-Fc]$_2$ |
| TNR$_{Fab}$-$X_c$ + $X_n$-Fc | 1 | [TNR$_{Fab}$-$X_c$-$X_n$-Fc]$_2$ |
| TNR$_{Fab}$-$X_c$ + Fc-$X_c$ | 1 | [Fc-$X_c$-$X_c$-TNR$_{Fab}$]$_2$ |
| TNR$_1$-$X_c$ + TNR$_2$-$X_c$ + $S_n$-Fc | 3 | [(TNR$_{1/2}$)-$X_c$-$S_n$-Fc]$_2$ |
| TNR$_1$-$X_c$ + TNR$_2$-$X_c$ + $X_n$-Fc | 3 | [(TNR$_{1/2}$)-$X_c$-$X_n$-Fc]$_2$ |
| TNR$_1$-$X_c$ + TNR$_2$-$X_c$ + Fc-$X_c$ | 3 | [Fc-$X_c$-$X_c$-(TNR$_{1/2}$)]$_2$ |
| TNR$_1$-$X_c$ + TNR$_{Fab}$-$X_c$ + $S_n$-Fc | 3 | [(TNR$_{1/Fab}$)-$X_c$-$S_n$-Fc]$_2$ |
| TNR$_1$-$X_c$ + TNR$_{Fab}$-$X_c$ + $X_n$-Fc | 3 | [(TNR$_{1/Fab}$)-$X_c$-$X_n$-Fc]$_2$ |
| TNR$_1$-$X_c$ + TNR$_{Fab}$-$X_c$ + Fc-$X_c$ | 3 | [Fc-$X_c$-$X_c$-(TNR$_{1/Fab}$)]$_2$ |
| TNR$_2$-$X_c$ + TNR$_{Fab}$-$X_c$ + $S_n$-Fc | 3 | [(TNR$_{2/Fab}$)-$X_c$-$S_n$-Fc]$_2$ |
| TNR$_2$-$X_c$ + TNR$_{Fab}$-$X_c$ + $X_n$-Fc | 3 | [(TNR$_{2/Fab}$)-$X_c$-$X_n$-Fc]$_2$ |
| TNR$_2$-$X_c$ + TNR$_{Fab}$-$X_c$ + Fc-$X_c$ | 3 | [Fc-$X_c$-$X_c$-(TNR$_{2/Fab}$)]$_2$ |
| TNR$_1$-$X_c$ + TNR$_2$-$X_c$ + TNR$_{Fab}$-$X_c$ + $S_n$-Fc | 6 | [(TNR$_{1/2/Fab}$)-$X_c$-$S_n$-Fc]$_2$ |
| TNR$_1$-$X_c$ + TNR$_2$-$X_c$ + TNR$_{Fab}$-$X_c$ + $X_n$-Fc | 6 | [(TNR$_{1/2/Fab}$)-$X_c$-$X_n$-Fc]$_2$ |
| TNR$_1$-$X_c$ + TNR$_2$-$X_c$ + TNR$_{Fab}$-$X_c$ + Fc-$X_c$ | 6 | [Fc-$X_c$-$X_c$-(TNR$_{1/2/Fab}$)]$_2$ |

TABLE 5

TNR Bi-Symmetroadhesins

| Stretches of Consecutive Amino Acids | # | Symmetroadhesin Configurations |
|---|---|---|
| TNR$_1$-$X_c$ + $S_n$-Fc-$X_c$ | 1 | [TNR$_1$-$X_c$-$S_n$-Fc-$X_c$-$X_c$-TNR$_1$]$_2$ |
| TNR$_1$-$X_c$ + $X_n$-Fc-$X_c$ | 1 | [TNR$_1$-$X_c$-$X_n$-Fc-$X_c$-$X_c$-TNR$_1$]$_2$ |
| TNR$_2$-$X_c$ + $S_n$-Fc-$X_c$ | 1 | [TNR$_2$-$X_c$-$S_n$-Fc-$X_c$-$X_c$-TNR$_2$]$_2$ |
| TNR$_2$-$X_c$ + $X_n$-Fc-$X_c$ | 1 | [TNR$_2$-$X_c$-$X_n$-Fc-$X_c$-$X_c$-TNR$_2$]$_2$ |
| TNR$_{Fab}$-$X_c$ + $S_n$-Fc-$X_c$ | 1 | [TNR$_{Fab}$-$X_c$-$S_n$-Fc-$X_c$-$X_c$-TNR$_{Fab}$]$_2$ |
| TNR$_{Fab}$-$X_c$ + $X_n$-Fc-$X_c$ | 1 | [TNR$_{Fab}$-$X_c$-$X_n$-Fc-$X_c$-$X_c$-TNR$_{Fab}$]$_2$ |
| TNR$_1$-$X_c$ + TNR$_2$-$X_c$ + $S_n$-Fc-$X_c$ | 12 | [(TNR$_{1/2}$)-$X_c$-$S_n$-Fc-$X_c$-$X_c$-(TNR$_{1/2}$)]$_2$ |
| TNR$_1$-$X_c$ + TNR$_2$-$X_c$ + $X_n$-Fc-$X_c$ | 12 | [(TNR$_{1/2}$)-$X_c$-$X_n$-Fc-$X_c$-$X_c$-(TNR$_{1/2}$)]$_2$ |
| TNR$_1$-$X_c$ + TNR$_{Fab}$-$X_c$ + $S_n$-Fc-$X_c$ | 12 | [(TNR$_{1/Fab}$)-$X_c$-$S_n$-Fc-$X_c$-$X_c$-(TNR$_{1/Fab}$)]$_2$ |
| TNR$_1$-$X_c$ + TNR$_{Fab}$-$X_c$ + $X_n$-Fc-$X_c$ | 12 | [(TNR$_{1/Fab}$)-$X_c$-$X_n$-Fc-$X_c$-$X_c$-(TNR$_{1/Fab}$)]$_2$ |
| TNR$_2$-$X_c$ + TNR$_{Fab}$-$X_c$ + $S_n$-Fc-$X_c$ | 12 | [(TNR$_{2/Fab}$)-$X_c$-$S_n$-Fc-$X_c$-$X_c$-(TNR$_{2/Fab}$)]$_2$ |
| TNR$_2$-$X_c$ + TNR$_{Fab}$-$X_c$ + $X_n$-Fc-$X_c$ | 12 | [(TNR$_{2/Fab}$)-$X_c$-$X_n$-Fc-$X_c$-$X_c$-(TNR$_{2/Fab}$)]$_2$ |
| TNR$_1$-$X_c$ + TNR$_2$-$X_c$ + TNR$_{Fab}$-$X_c$ + $S_n$-Fc-$X_c$ | 63 | [(TNR$_{1/2/Fab}$)-$X_c$-$X_n$-Fc-$X_c$-$X_c$-(TNR$_{1/2/Fab}$)]$_2$ |
| TNR$_1$-$X_c$ + TNR$_2$-$X_c$ + TNR$_{Fab}$-$X_c$ + $S_n$-Fc-$X_c$ | 63 | [(TNR$_{1/2/Fab}$)-$X_c$-$X_n$-Fc-$X_c$-$X_c$-(TNR$_{1/2/Fab}$)]$_2$ |

TABLE 6

VGFR Hemi-Symmetroadhesins

| Stretches of Consecutive Amino Acids | # | Symmetroadhesin Configurations |
|---|---|---|
| VGFR$_1$-$X_c$ | 1 | [VGFR$_1$-$X_c$-$X_c$-VGFR$_1$] |
| VGFR$_2$-$X_c$ | 1 | [VGFR$_2$-$X_c$-$X_c$-VGFR$_2$] |
| VGFR$_3$-$X_c$ | 1 | [VGFR$_3$-$X_c$-$X_c$-VGFR$_3$] |
| VGFR$_1$-$X_c$ + VGFR$_2$-$X_c$ | 3 | [(VGFR$_{1/2}$)-$X_c$-$X_c$-(VGFR$_{1/2}$)] |
| VGFR$_1$-$X_c$ + VGFR$_3$-$X_c$ | 3 | [(VGFR$_{1/3}$)-$X_c$-$X_c$-(VGFR$_{1/3}$)] |
| VGFR$_2$-$X_c$ + VGFR$_3$-$X_c$ | 3 | [(VGFR$_{2/3}$)-$X_c$-$X_c$-(VGFR$_{2/3}$)] |
| VGFR$_1$-$X_c$ + VGFR$_2$-$X_c$ + VGFR$_3$-$X_c$ | 6 | [(VGFR$_{1/2/3}$)-$X_c$-$X_c$-(VGFR$_{1/2/3}$)] |

TABLE 7

VGFR ImmunoSymmetroadhesins

| Stretches of Consecutive Amino Acids | # | Symmetroadhesin Configurations |
|---|---|---|
| VGFR$_1$-$X_c$ + $S_n$-Fc | 1 | [VGFR$_1$-$X_c$-$S_n$-Fc]$_2$ |
| VGFR$_1$-$X_c$ + $X_n$-Fc | 1 | [VGFR$_1$-$X_c$-$X_n$-Fc]$_2$ |
| VGFR$_1$-$X_c$ + Fc-$X_c$ | 1 | [Fc-$X_c$-$X_c$-VGFR$_1$]$_2$ |
| VGFR$_2$-$X_c$ + $S_n$-Fc | 1 | [VGFR$_2$-$X_c$-$S_n$-Fc]$_2$ |
| VGFR$_2$-$X_c$ + $X_n$-Fc | 1 | [VGFR$_2$-$X_c$-$X_n$-Fc]$_2$ |
| VGFR$_2$-$X_c$ + Fc-$X_c$ | 1 | [Fc-$X_c$-$X_c$-VGFR$_2$]$_2$ |
| VGFR$_3$-$X_c$ + $S_n$-Fc | 1 | [VGFR$_3$-$X_c$-$S_n$-Fc]$_2$ |
| VGFR$_3$-$X_c$ + $X_n$-Fc | 1 | [VGFR$_3$-$X_c$-$X_n$-Fc]$_2$ |
| VGFR$_3$-$X_c$ + Fc-$X_c$ | 1 | [Fc-$X_c$-$X_c$-VGFR$_3$]$_2$ |

TABLE 7-continued

VGFR ImmunoSymmetroadhesins

| Stretches of Consecutive Amino Acids | # | Symmetroadhesin Configurations |
|---|---|---|
| $VGFR_1-X_c + VGFR_2-X_c + S_n-Fc$ | 3 | $[(VGFR_{1/2})-X_c-S_n-Fc]_2$ |
| $VGFR_1-X_c + VGFR_2-X_c + X_n-Fc$ | 3 | $[(VGFR_{1/2})-X_c-X_n-Fc]_2$ |
| $VGFR_1-X_c + VGFR_2-X_c + Fc-X_c$ | 3 | $[Fc-X_c-X_c-(VGFR_{1/2})]_2$ |
| $VGFR_1-X_c + VGFR_3-X_c + S_n-Fc$ | 3 | $[(VGFR_{1/3})-X_c-S_n-Fc]_2$ |
| $VGFR_1-X_c + VGFR_3-X_c + X_n-Fc$ | 3 | $[(VGFR_{1/3})-X_c-X_n-Fc]_2$ |
| $VGFR_1-X_c + VGFR_3-X_c + Fc-X_c$ | 3 | $[Fc-X_c-X_c-(VGFR_{1/3})]_2$ |
| $VGFR_2-X_c + VGFR_3-X_c + S_n-Fc$ | 3 | $[(VGFR_{2/3})-X_c-S_n-Fc]_2$ |
| $VGFR_2-X_c + VGFR_3-X_c + X_n-Fc$ | 3 | $[(VGFR_{2/3})-X_c-X_n-Fc]_2$ |
| $VGFR_2-X_c + VGFR_3-X_c + Fc-X_c$ | 3 | $[Fc-X_c-X_c-(VGFR_{2/3})]_2$ |
| $VGFR_1-X_c + VGFR_2-X_c + VGFR_3-X_c + S_n-Fc$ | 6 | $[(VGFR_{1/2/3})-X_c-S_n-Fc]_2$ |
| $VGFR_1-X_c + VGFR_2-X_c + VGFR_3-X_c + X_n-Fc$ | 6 | $[(VGFR_{1/2/3})-X_c-X_n-Fc]_2$ |
| $VGFR_1-X_c + VGFR_2-X_c + VGFR_3-X_c + Fc-X_c$ | 6 | $[Fc-X_c-X_c-(VGFR_{1/2/3})]_2$ |

TABLE 8

VGFR Bi-Symmetroadhesins

| Stretches of Consecutive Amino Acids | # | Symmetroadhesin Configurations |
|---|---|---|
| $VGFR_1-X_c + S_n-Fc-X_c$ | 1 | $[VGFR_1-X_c-S_n-Fc-X_c-X_c-VGFR_1]_2$ |
| $VGFR_1-X_c + X_n-Fc-X_c$ | 1 | $[VGFR_1-X_c-X_n-Fc-X_c-X_c-VGFR_1]_2$ |
| $VGFR_2-X_c + S_n-Fc-X_c$ | 1 | $[VGFR_2-X_c-S_n-Fc-X_c-X_c-VGFR_2]_2$ |
| $VGFR_2-X_c + X_n-Fc-X_c$ | 1 | $[VGFR_2-X_c-X_n-Fc-X_c-X_c-VGFR_2]_2$ |
| $VGFR_3-X_c + S_n-Fc-X_c$ | 1 | $[VGFR_3-X_c-S_n-Fc-X_c-X_c-VGFR_3]_2$ |
| $VGFR_3-X_c + X_n-Fc-X_c$ | 1 | $[VGFR_3-X_c-X_n-Fc-X_c-X_c-VGFR_3]_2$ |
| $VGFR_1-X_c + VGFR_2-X_c + S_n-Fc-X_c$ | 12 | $[(VGFR_{1/2})-X_c-S_n-Fc-X_c-X_c-(VGFR_{1/2})]_2$ |
| $VGFR_1-X_c + VGFR_2-X_c + X_n-Fc-X_c$ | 12 | $[(VGFR_{1/2})-X_c-X_n-Fc-X_c-X_c-(VGFR_{1/2})]_2$ |
| $VGFR_1-X_c + VGFR_3-X_c + S_n-Fc-X_c$ | 12 | $[(VGFR_{1/3})-X_c-S_n-Fc-X_c-X_c-(VGFR_{1/3})]_2$ |
| $VGFR_1-X_c + VGFR_3-X_c + X_n-Fc-X_c$ | 12 | $[(VGFR_{1/3})-X_c-X_n-Fc-X_c-X_c-(VGFR_{1/3})]_2$ |
| $VGFR_2-X_c + VGFR_3-X_c + S_n-Fc-X_c$ | 12 | $[(VGFR_{2/3})-X_c-S_n-Fc-X_c-X_c-(VGFR_{2/3})]_2$ |
| $VGFR_2-X_c + VGFR_3-X_c + X_n-Fc-X_c$ | 12 | $[(VGFR_{2/3})-X_c-X_n-Fc-X_c-X_c-(VGFR_{2/3})]_2$ |
| $VGFR_1-X_c + VGFR_2-X_c + VGFR_3-X_c + S_n-Fc-X_c$ | 63 | $[(VGFR_{1/2/3})-X_c-X_n-Fc-X_c-X_c-(VGFR_{1/2/3})]_2$ |
| $VGFR_1-X_c + VGFR_2-X_c + VGFR_3-X_c + S_n-Fc-X_c$ | 63 | $[(VGFR_{1/2/3})-X_c-X_n-Fc-X_c-X_c-(VGFR_{1/2/3})]_2$ |

TABLE 9

ErbB Hemi-Symmetroadhesins

| Stretches of Consecutive Amino Acids | # | Symmetroadhesin Configurations |
|---|---|---|
| $ErbB_1-X_c$ | 1 | $[ErbB_1-X_c-X_c-ErbB_1]$ |
| $ErbB_2-X_c$ | 1 | $[ErbB_2-X_c-X_c-ErbB_2]$ |
| $ErbB_3-X_c$ | 1 | $[ErbB_3-X_c-X_c-ErbB_3]$ |
| $ErbB_4-X_c$ | 1 | $[ErbB_4-X_c-X_c-ErbB_4]$ |
| $ErbB_1-X_c + ErbB_2-X_c$ | 3 | $[(ErbB_{1/2})-X_c-X_c-(ErbB_{1/2})]$ |
| $ErbB_1-X_c + ErbB_3-X_c$ | 3 | $[(ErbB_{1/3})-X_c-X_c-(ErbB_{1/3})]$ |
| $ErbB_1-X_c + ErbB_4-X_c$ | 3 | $[(ErbB_{1/4})-X_c-X_c-(ErbB_{1/4})]$ |
| $ErbB_2-X_c + ErbB_3-X_c$ | 3 | $[(ErbB_{2/3})-X_c-X_c-(ErbB_{2/3})]$ |
| $ErbB_2-X_c + ErbB_4-X_c$ | 3 | $[(ErbB_{2/4})-X_c-X_c-(ErbB_{2/4})]$ |
| $ErbB_3-X_c + ErbB_4-X_c$ | 3 | $[(ErbB_{3/4})-X_c-X_c-(ErbB_{3/4})]$ |
| $ErbB_1-X_c + ErbB_2-X_c + ErbB_3-X_c$ | 6 | $[(ErbB_{1/2/3})-X_c-X_c-(ErbB_{1/2/3})]$ |
| $ErbB_1-X_c + ErbB_2-X_c + ErbB_4-X_c$ | 6 | $[(ErbB_{1/2/4})-X_c-X_c-(ErbB_{1/2/4})]$ |
| $ErbB_1-X_c + ErbB_3-X_c + ErbB_4-X_c$ | 6 | $[(ErbB_{1/3/4})-X_c-X_c-(ErbB_{1/3/4})]$ |
| $ErbB_2-X_c + ErbB_3-X_c + ErbB_4-X_c$ | 6 | $[(ErbB_{2/3/4})-X_c-X_c-(ErbB_{2/3/4})]$ |
| $ErbB_1-X_c + ErbB_2-X_c + ErbB_3-X_c + ErbB_4-X_c$ | 10 | $[(ErbB_{1/2/3/4})-X_c-X_c-(ErbB_{1/2/3/4})]$ |

TABLE 10

ErbB ImmunoSymmetroadhesins

| Stretches of Consecutive Amino Acids | # | Symmetroadhesin Configurations |
|---|---|---|
| $ErbB_1-X_c + X_n-Fc$ | 1 | $[ErbB_1-X_c-X_n-Fc]_2$ |
| $ErbB_1-X_c + Fc-X_c$ | 1 | $[Fc-X_c-X_c-ErbB_1]_2$ |
| $ErbB_2-X_c + X_n-Fc$ | 1 | $[ErbB_2-X_c-X_n-Fc]_2$ |
| $ErbB_2-X_c + Fc-X_c$ | 1 | $[Fc-X_c-X_c-ErbB_2]_2$ |
| $ErbB_3-X_c + X_n-Fc$ | 1 | $[ErbB_3-X_c-X_n-Fc]_2$ |
| $ErbB_3-X_c + Fc-X_c$ | 1 | $[Fc-X_c-X_c-ErbB_3]_2$ |
| $ErbB_4-X_c + X_n-Fc$ | 1 | $[ErbB_4-X_c-X_n-Fc]_2$ |
| $ErbB_4-X_c + Fc-X_c$ | 1 | $[Fc-X_c-X_c-ErbB_4]_2$ |
| $ErbB_1-X_c + ErbB_2-X_c + X_n-Fc$ | 3 | $[(ErbB_{1/2})-X_c-X_n-Fc]_2$ |
| $ErbB_1-X_c + ErbB_2-X_c + Fc-X_c$ | 3 | $[Fc-X_c-X_c-(ErbB_{1/2})]_2$ |
| $ErbB_1-X_c + ErbB_3-X_c + X_n-Fc$ | 3 | $[(ErbB_{1/3})-X_c-X_n-Fc]_2$ |
| $ErbB_1-X_c + ErbB_3-X_c + Fc-X_c$ | 3 | $[Fc-X_c-X_c-(ErbB_{1/3})]_2$ |
| $ErbB_1-X_c + ErbB_4-X_c + X_n-Fc$ | 3 | $[(ErbB_{1/4})-X_c-X_n-Fc]_2$ |
| $ErbB_1-X_c + ErbB_4-X_c + Fc-X_c$ | 3 | $[Fc-X_c-X_c-(ErbB_{1/4})]_2$ |
| $ErbB_2-X_c + ErbB_3-X_c + X_n-Fc$ | 3 | $[(ErbB_{2/3})-X_c-X_n-Fc]_2$ |
| $ErbB_2-X_c + ErbB_3-X_c + Fc-X_c$ | 3 | $[Fc-X_c-X_c-(ErbB_{2/3})]_2$ |
| $ErbB_2-X_c + ErbB_4-X_c + X_n-Fc$ | 3 | $[(ErbB_{2/4})-X_c-X_n-Fc]_2$ |
| $ErbB_2-X_c + ErbB_4-X_c + Fc-X_c$ | 3 | $[Fc-X_c-X_c-(ErbB_{2/4})]_2$ |
| $ErbB_3-X_c + ErbB_4-X_c + X_n-Fc$ | 3 | $[(ErbB_{3/4})-X_c-X_n-Fc]_2$ |
| $ErbB_3-X_c + ErbB_4-X_c + Fc-X_c$ | 3 | $[Fc-X_c-X_c-(ErbB_{3/4})]_2$ |
| $ErbB_1-X_c + ErbB_2-X_c + ErbB_3-X_c + X_n-Fc$ | 6 | $[(ErbB_{1/2/3})-X_c-X_n-Fc]_2$ |
| $ErbB_1-X_c + ErbB_2-X_c + ErbB_3-X_c + Fc-X_c$ | 6 | $[Fc-X_c-X_c-(ErbB_{1/2/3})]_2$ |
| $ErbB_1-X_c + ErbB_2-X_c + ErbB_4-X_c + X_n-Fc$ | 6 | $[(ErbB_{1/2/4})-X_c-X_n-Fc]_2$ |
| $ErbB_1-X_c + ErbB_2-X_c + ErbB_4-X_c + Fc-X_c$ | 6 | $[Fc-X_c-X_c-(ErbB_{1/2/4})]_2$ |
| $ErbB_1-X_c + ErbB_3-X_c + ErbB_4-X_c + X_n-Fc$ | 6 | $[(ErbB_{1/3/4})-X_c-X_n-Fc]_2$ |
| $ErbB_1-X_c + ErbB_3-X_c + ErbB_4-X_c + Fc-X_c$ | 6 | $[Fc-X_c-X_c-(ErbB_{1/3/4})]_2$ |
| $ErbB_2-X_c + ErbB_3-X_c + ErbB_4-X_c + X_n-Fc$ | 6 | $[(ErbB_{2/3/4})-X_c-X_n-Fc]_2$ |
| $ErbB_2-X_c + ErbB_3-X_c + ErbB_4-X_c + Fc-X_c$ | 6 | $[Fc-X_c-X_c-(ErbB_{2/3/4})]_2$ |
| $ErbB_1-X_c + ErbB_2-X_c + ErbB_3-X_c + ErbB_4-X_c + X_n-Fc$ | 10 | $[(ErbB_{1/2/3/4})-X_c-X_n-Fc]_2$ |
| $ErbB_1-X_c + ErbB_2-X_c + ErbB_3-X_c + ErbB_4-X_c + Fc-X_c$ | 10 | $[Fc-X_c-X_c-(ErbB_{1/2/3/4})]_2$ |

TABLE 11

ErbB Bi-Symmetroadhesins

| Stretches of Consecutive Amino Acids | # | Symmetroadhesin Configurations |
|---|---|---|
| $ErbB_1$-$X_c$ + $X_n$-Fc-$X_c$ | 1 | [$ErbB_1$-$X_c$-$X_n$-Fc-$X_c$-$X_c$-$ErbB_1$]$_2$ |
| $ErbB_2$-$X_c$ + $X_n$-Fc-$X_c$ | 1 | [$ErbB_2$-$X_c$-$X_n$-Fc-$X_c$-$X_c$-$ErbB_2$]$_2$ |
| $ErbB_3$-$X_c$ + $X_n$-Fc-$X_c$ | 1 | [$ErbB_3$-$X_c$-$X_n$-Fc-$X_c$-$X_c$-$ErbB_3$]$_2$ |
| $ErbB_4$-$X_c$ + $X_n$-Fc-$X_c$ | 1 | [$ErbB_4$-$X_c$-$X_n$-Fc-$X_c$-$X_c$-$ErbB_4$]$_2$ |
| $ErbB_1$-$X_c$ + $ErbB_2$-$X_c$ + $X_n$-Fc-$X_c$ | 12 | [($ErbB_{1/2}$)-$X_c$-$X_n$-Fc-$X_c$-$X_c$-($ErbB_{1/2}$)]$_2$ |
| $ErbB_1$-$X_c$ + $ErbB_3$-$X_c$ + $X_n$-Fc-$X_c$ | 12 | [($ErbB_{1/3}$)-$X_c$-$X_n$-Fc-$X_c$-$X_c$-($ErbB_{1/3}$)]$_2$ |
| $ErbB_1$-$X_c$ + $ErbB_4$-$X_c$ + $X_n$-Fc-$X_c$ | 12 | [($ErbB_{1/4}$)-$X_c$-$X_n$-Fc-$X_c$-$X_c$-($ErbB_{1/4}$)]$_2$ |
| $ErbB_2$-$X_c$ + $ErbB_3$-$X_c$ + $X_n$-Fc-$X_c$ | 12 | [($ErbB_{2/3}$)-$X_c$-$X_n$-Fc-$X_c$-$X_c$-($ErbB_{2/3}$)]$_2$ |
| $ErbB_2$-$X_c$ + $ErbB_4$-$X_c$ + $X_n$-Fc-$X_c$ | 12 | [($ErbB_{2/4}$)-$X_c$-$X_n$-Fc-$X_c$-$X_c$-($ErbB_{2/4}$)]$_2$ |
| $ErbB_3$-$X_c$ + $ErbB_4$-$X_c$ + $X_n$-Fc-$X_c$ | 12 | [($ErbB_{3/4}$)-$X_c$-$X_n$-Fc-$X_c$-$X_c$-($ErbB_{3/4}$)]$_2$ |
| $ErbB_1$-$X_c$ + $ErbB_2$-$X_c$ + $ErbB_3$-$X_c$ + $X_n$-Fc-$X_c$ | 63 | [($ErbB_{1/2/3}$)-$X_c$-$X_n$-Fc-$X_c$-$X_c$-($ErbB_{1/2/3}$)]$_2$ |
| $ErbB_1$-$X_c$ + $ErbB_2$-$X_c$ + $ErbB_4$-$X_c$ + $X_n$-Fc-$X_c$ | 63 | [($ErbB_{1/2/4}$)-$X_c$-$X_n$-Fc-$X_c$-$X_c$-($ErbB_{1/2/4}$)]$_2$ |
| $ErbB_1$-$X_c$ + $ErbB_3$-$X_c$ + $ErbB_4$-$X_c$ + $X_n$-Fc-$X_c$ | 63 | [($ErbB_{1/3/4}$)-$X_c$-$X_n$-Fc-$X_c$-$X_c$-($ErbB_{1/3/4}$)]$_2$ |
| $ErbB_2$-$X_c$ + $ErbB_3$-$X_c$ + $ErbB_4$-$X_c$ + $X_n$-Fc-$X_c$ | 63 | [($ErbB_{2/3/4}$)-$X_c$-$X_n$-Fc-$X_c$-$X_c$-($ErbB_{2/3/4}$)]$_2$ |
| $ErbB_1$-$X_c$ + $ErbB_2$-$X_c$ + $ErbB_3$-$X_c$ + $ErbB_4$-$X_c$ + $X_n$-Fc-$X_c$ | | [($ErbB_{1/2/3/4}$)-$X_c$-$X_n$-Fc-$X_c$-$X_c$-($ErbB_{1/2/3/4}$)]$_2$ |

Stretches of Consecutive Amino Acids

Examples of stretches of consecutive amino acids as referred to herein include, but are not limited to, consecutive amino acids including binding domains such as secreted or transmembrane proteins, intracellular binding domains and antibodies (whole or portions thereof) and modified versions thereof. The following are some non-limiting examples:

1) Immunoglobulins

Immunoglobulins are molecules containing polypeptide chains held together by intra-chain disulfide bonds, wherein at least one of the bonded amino acids is not a terminus residue, typically having two light chains and two heavy chains. In each chain, one domain (V) has a variable amino acid sequence depending on the antibody specificity of the molecule. The other domains (C) have a rather constant sequence common among molecules of the same class. The domains are numbered in sequence from the amino-terminal end.

The immunoglobulin gene superfamily consists of molecules with immunoglobulin-like domains. Members of this family include class I and class II major histocompatibility antigens, immunoglobulins, T-cell receptor alpha, beta, gamma and delta chains, CD1, CD2, CD4, CD8, CD28, the gamma, delta and epsilon chains of CD3, OX-2, Thy-1, the intercellular or neural cell adhesion molecules (I-CAM or N-CAM), lymphocyte function associated antigen-3 (LFA-3), neurocytoplasmic protein (NCP-3), poly-Ig receptor, myelin-associated glycoprotein (MAG), high affinity IgE receptor, the major glycoprotein of peripheral myelin (Po), platelet derived growth factor receptor, colony stimulating factor-1 receptor, macrophage Fc receptor, Fc gamma receptors and carcinoembryonic antigen.

It is known that one can substitute variable domains (including hypervariable regions) of one immunoglobulin for another, and from one species to another. See, for example, EP 0 173 494; EP 0 125 023; Munro, Nature 312 (13 Dec. 1984); Neuberger et al., Nature 312: (13 Dec. 1984); Sharon et al., Nature 309 (May 24, 1984); Morrison et al., Proc. Natl. Acad. Sci. USA 81:6851-6855 (1984); Morrison et al. Science 229:1202-1207 (1985); and Boulianne et al., Nature 312:643-646 (Dec. 13, 1984).

Morrison et al., Science 229:1202-1207 (1985) teaches the preparation of an immunoglobulin chimera having a variable region from one species fused to an immunoglobulin constant region from another species.

It has also been shown that it is possible to substitute immunoglobulin variable-like domains from two members of the immunoglobulin gene superfamily—CD4 and the T cell receptor—for a variable domain in an immunoglobulin; see e.g. Capon et al., Nature 337:525-531, 1989, Traunecker et al., Nature 339:68-70, 1989, Gascoigne et al., Proc. Nat. Acad. Sci. 84:2936-2940, 1987, and published European application EPO 0 325 224 A2.

U.S. Pat. No. 5,116,964 (Capon et al., May 26, 1992), hereby incorporated by reference, describes hybrid immunoglobulins commonly referred to as immunoadhesins, which combine, for example, the adhesive and targeting properties of a ligand binding partner with immunoglobulin effector functions. U.S. Pat. No. 5,336,603 (Capon et al., Aug. 9, 1994), hereby incorporated by reference, describes a heterofunctional immunoadhesin comprising a fusion protein in which a polypeptide comprising a human CD4 antigen variable (V) region is fused at its C-terminus to the N-terminus of a polypeptide comprising a constant region of an immunoglobulin chain disulfide bonded to a companion immunoglobulin heavy chain-light chain pair bearing a antibody combining site capable of binding a predetermined antigen.

"Components" of immunoglobulins include antibody fragments comprise a portion of an intact antibody, preferably the antigen binding or variable region of the intact antibody. Examples of antibody fragments include Fab, Fab', F(ab')$_2$, and Fv fragments; diabodies; linear antibodies (Zapata et al., Protein Eng. 8(10): 1057-1062 (1995)); single-chain antibody molecules; and multispecific antibodies formed from antibody fragments.

Papain digestion of antibodies produces two identical antigen-binding fragments, called "Fab" fragments, each with a single antigen-binding site, and a residual "Fc" fragment, a designation reflecting the ability to crystallize readily. Pepsin treatment yields an F(ab')$_2$ fragment that has two antigen-combining sites and is still capable of cross-linking antigen.

"Fv" is the minimum antibody fragment which contains a complete antigen-recognition and -binding site. This region consists of a dimer of one heavy- and one light-chain variable domain in tight, non-covalent association.

It is in this configuration that the three CDRs of each variable domain interact to define an antigen-binding site on the surface of the $V_H$-$V_L$ dimer. Collectively, the six CDRs confer antigen-binding specificity to the antibody. However, even a single variable domain (or half of an Fv comprising only three CDRs specific for an antigen) has the ability to recognize and bind antigen, although at a lower affinity than the entire binding site.

The Fab fragment also contains the constant domain of the light chain and the first constant domain (CH1) of the heavy chain. Fab fragments differ from Fab' fragments by the addition of a few residues at the carboxy terminus of the heavy chain CH1 domain including one or more cysteines from the antibody hinge region. Fab'-SH is the designation herein for Fab' in which the cysteine residue(s) of the constant domains bear a free thiol group. F(ab')$_2$ antibody fragments originally were produced as pairs of Fab' fragments which have hinge cysteines between them. Other chemical couplings of antibody fragments are also known.

The "light chains" of antibodies (immunoglobulins) from any vertebrate species can be assigned to one of two clearly distinct types, called kappa and lambda, based on the amino acid sequences of their constant domains.

Depending on the amino acid sequence of the constant domain of their heavy chains, immunoglobulins can be assigned to different classes. There are five major classes of immunoglobulins: IgA, IgD, IgE, IgG, and IgM, and several of these may be further divided into subclasses (isotypes), e.g., IgG1, IgG2, IgG3, IgG4, IgA, and IgA2.

"Single-chain Fv" or "sFv" antibody fragments comprise the $V_H$ and $V_L$ domains of antibody, wherein these domains are present in a single polypeptide chain. Preferably, the Fv polypeptide further comprises a polypeptide linker between the $V_H$ and $V_L$ domains which enables the sFv to form the desired structure for antigen binding. For a review of sFv, see Pluckthun in The Pharmacology of Monoclonal Antibodies, vol. 113, Rosenburg and Moore eds., Springer-Verlag, New York, pp. 269-315 (1994).

Thus, linking of the various components of immunoglobulins and other biologically active molecules has allowed production of hybrid molecules which retain the functionalities of the individual components.

In an embodiment, the invention described herein provides novel hybrid molecules which include one or more immunoglobulin components.

2) Extracellular Proteins

Extracellular proteins play important roles in, among other things, the formation, differentiation and maintenance of multicellular organisms. A discussion of various intracellular proteins of interest is set forth in U.S. Pat. No. 6,723,535, Ashkenazi et al., issued Apr. 20, 2004, hereby incorporated by reference.

The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. These secreted polypeptides or signaling molecules normally pass through the cellular secretory pathway to reach their site of action in the extracellular environment.

Secreted proteins have various industrial applications, including as pharmaceuticals, diagnostics, biosensors and bioreactors. Most protein drugs available at present, such as thrombolytic agents, interferons, interleukins, erythropoietins, colony stimulating factors, and various other cytokines, are secretory proteins. Their receptors, which are membrane proteins, also have potential as therapeutic or diagnostic agents. Efforts are being undertaken by both industry and academia to identify new, native secreted proteins. Many efforts are focused on the screening of mammalian recombinant DNA libraries to identify the coding sequences for novel secreted proteins. Examples of screening methods and techniques are described in the literature (see, for example, Klein et al., Proc. Natl. Acad. Sci. 93:7108-7113 (1996); U.S. Pat. No. 5,536,637)).

Membrane-bound proteins and receptors can play important roles in, among other things, the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. Such membrane-bound proteins and cell receptors include, but are not limited to, cytokine receptors, receptor kinases, receptor phosphatases, receptors involved in cell-cell interactions, and cellular adhesin molecules like selectins and integrins. For instance, transduction of signals that regulate cell growth and differentiation is regulated in part by phosphorylation of various cellular proteins. Protein tyrosine kinases, enzymes that catalyze that process, can also act as growth factor receptors. Examples include fibroblast growth factor receptor and nerve growth factor receptor.

Membrane-bound proteins and receptor molecules have various industrial applications, including as pharmaceutical and diagnostic agents. Receptor immunoadhesins, for instance, can be employed as therapeutic agents to block receptor-ligand interactions. The membrane-bound proteins can also be employed for screening of potential peptide or small molecule inhibitors of the relevant receptor/ligand interaction.

Examples of such proteins include EGF and growth factors.

Epidermal growth factor (EGF) is a conventional mitogenic factor that stimulates the proliferation of various types of cells including epithelial cells and fibroblasts. EGF binds to and activates the EGF receptor (EGFR), which initiates intracellular signaling and subsequent effects. The EGFR is expressed in neurons of the cerebral cortex, cerebellum, and hippocampus in addition to other regions of the central nervous system (CNS). In addition, EGF is also expressed in various regions of the CNS. Therefore, EGF acts not only on mitotic cells, but also on postmitotic neurons. In fact, many studies have indicated that EGF has neurotrophic or neuromodulatory effects on various types of neurons in the CNS. For example, EGF acts directly on cultured cerebral cortical and cerebellar neurons, enhancing neurite outgrowth and survival. On the other hand, EGF also acts on other cell types, including septal cholinergic and mesencephalic dopaminergic neurons, indirectly through glial cells. Evidence of the effects of EGF on neurons in the CNS is accumulating, but the mechanisms of action remain essentially unknown. EGF-induced signaling in mitotic cells is better understood than in postmitotic neurons. Studies of cloned pheochromocytoma PC12 cells and cultured cerebral cortical neurons have suggested that the EGF-induced neurotrophic actions are mediated by sustained activation of the EGFR and mitogen-activated protein kinase (MAPK) in response to EGF. The sustained intracellular signaling correlates with the decreased rate of EGFR down-regulation, which might determine the response of neuronal cells to EGF. It is likely that EGF is a multi-potent growth factor that acts upon various types of cells including mitotic cells and postmitotic neurons.

EGF is produced by the salivary and Brunner's glands of the gastrointestinal system, kidney, pancreas, thyroid gland, pituitary gland, and the nervous system, and is found in body fluids such as saliva, blood, cerebrospinal fluid (CSF), urine, amniotic fluid, prostatic fluid, pancreatic juice, and breast milk, Plata-Salaman, Peptides 12:653-663 (1991).

EGF is mediated by its membrane specific receptor, which contains an intrinsic tyrosine kinase. Stoscheck et al., J. Cell Biochem. 31:135-152 (1986). EGF is believed to function by binding to the extracellular portion of its receptor which induces a transmembrane signal that activates the intrinsic tyrosine kinase.

Purification and sequence analysis of the EGF-like domain has revealed the presence of six conserved cysteine residues which cross-bind to create three peptide loops, Savage et al., J. Biol. Chem. 248:7669-7672 (1979). It is now generally known that several other peptides can react with the EGF receptor which share the same generalized motif $X_n$ $CX_7$ $CX_{4/5}$ $CX_{10}$ $CXCX_5$ $GX_2$ $CX_n$, where X represents any non-cysteine amino acid, and n is a variable repeat number. Non isolated peptides having this motif include TGF-alpha, amphiregulin, schwannoma-derived growth factor (SDGF), heparin-binding EGF-like growth factors and certain virally encoded peptides (e.g., Vaccinia virus, Reisner, Nature 313:801-803 (1985), Shope fibroma virus, Chang et al., Mol Cell Biol. 7:535-540 (1987), Molluscum contagiosum, Porter and Archard, J. Gen. Virol. 68:673-682 (1987), and Myxoma virus, Upton et al., J. Virol. 61:1271-1275 (1987), Prigent and Lemoine, Prog. Growth Factor Res. 4:1-24 (1992).

EGF-like domains are not confined to growth factors but have been observed in a variety of cell-surface and extracellular proteins which have interesting properties in cell adhesion, protein-protein interaction and development, Laurence and Gusterson, Tumor Biol. 11:229-261 (1990). These proteins include blood coagulation factors (factors VI, IX, X, XII, protein C, protein S, protein Z, tissue plasminogen activator, urokinase), extracellular matrix components (laminin, cytotactin, entactin), cell surface receptors (LDL receptor, thrombomodulin receptor) and immunity-related proteins (complement Clr, uromodulin).

Even more interesting, the general structure pattern of EGF-like precursors is preserved through lower organisms as well as in mammalian cells. A number of genes with developmental significance have been identified in invertebrates with EGF-like repeats. For example, the notch gene of Drosophila encodes 36 tandemly arranged 40 amino acid repeats which show homology to EGF, Wharton et al., Cell 43:557-581 (1985). Hydropathy plots indicate a putative membrane spanning domain, with the EGF-related sequences being located on the extracellular side of the membrane. Other homeotic genes with EGF-like repeats include Delta, 95F and 5ZD which were identified using probes based on Notch, and the nematode gene Lin-12 which encodes a putative receptor for a developmental signal transmitted between two specified cells.

Specifically, EGF has been shown to have potential in the preservation and maintenance of gastrointestinal mucosa and the repair of acute and chronic mucosal lesions, Konturek et al., Eur. J. Gastroenterol Hepatol. 7 (10), 933-37 (1995), including the treatment of necrotizing enterocolitis, Zollinger-Ellison syndrome, gastrointestinal ulceration gastrointestinal ulcerations and congenital microvillus atrophy, Guglietta and Sullivan, Eur. J. Gastroenterol Hepatol, 7(10), 945-50 (1995). Additionally, EGF has been implicated in hair follicle differentiation; du Cros, J. Invest. Dermatol. 101 (1 Suppl.), 106S-113S (1993), Hillier, Clin. Endocrinol. 33(4), 427-28 (1990); kidney function, Hamm et al., Semin. Nephrol. 13(1): 109-15 (1993), Harris, Am. J. Kidney Dis. 17(6): 627-30 (1991); tear fluid, van Setten et al., Int. Ophthalmol 15(6); 359-62 (1991); vitamin K mediated blood coagulation, Stenflo et al., Blood 78(7): 1637-51 (1991). EGF is also implicated various skin disease characterized by abnormal keratinocyte differentiation, e.g., psoriasis, epithelial cancers such as squamous cell carcinomas of the lung, epidermoid carcinoma of the vulva and gliomas. King et al., Am. J. Med. Sci. 296:154-158 (1988).

Of great interest is mounting evidence that genetic alterations in growth factors signaling pathways are closely linked to developmental abnormalities and to chronic diseases including cancer. Aaronson, Science 254: 1146-1153 (1991). For example, c-erb-2 (also known as HER-2), a proto-oncogene with close structural similarity to EGF receptor protein, is overexpressed in human breast cancer. King et al., Science 229:974-976 (1985); Gullick, Hormones and their actions, Cooke et al., eds, Amsterdam, Elsevier, pp 349-360 (1986).

Growth factors are molecular signals or mediators that enhance cell growth or proliferation, alone or in concert, by binding to specific cell surface receptors. However, there are other cellular reactions than only growth upon expression to growth factors. As a result, growth factors are better characterized as multifunctional and potent cellular regulators. Their biological effects include proliferation, chemotaxis and stimulation of extracellular matrix production. Growth factors can have both stimulatory and inhibitory effects. For example, transforming growth factor (TGF-beta) is highly pleiotropic and can stimulate proliferation in some cells, especially connective tissue, while being a potent inhibitor of proliferation in others, such as lymphocytes and epithelial cells.

The physiological effect of growth stimulation or inhibition by growth factors depends upon the state of development and differentiation of the target tissue. The mechanism of local cellular regulation by classical endocrine molecules involves comprehends autocrine (same cell), juxtacrine (neighbor cell), and paracrine (adjacent cells) pathways. Peptide growth factors are elements of a complex biological language, providing the basis for intercellular communication. They permit cells to convey information between each other, mediate interaction between cells and change gene expression. The effect of these multifunctional and pluripotent factors is dependent on the presence or absence of other peptides.

FGF-8 is a member of the fibroblast growth factors (FGFs) which are a family of heparin-binding, potent mitogens for both normal diploid fibroblasts and established cell lines, Gospodarowicz et al. (1984), Proc. Nat. Acad. Sci. USA 81:6963. The FGF family comprises acidic FGF (FGF-1), basic FGF (FGF-2), INT-2 (FGF-3), K-FGF/HST (FGF-4), FGF-5, FGF-6, KGF (FGF-7), AIGF (FGF-8) among others. All FGFs have two conserved cysteine residues and share 30-50% sequence homology at the amino acid level. These factors are mitogenic for a wide variety of normal diploid mesoderm-derived and neural crest-derived cells, including granulosa cells, adrenal cortical cells, chondrocytes, myoblasts, corneal and vascular endothelial cells (bovine or human), vascular smooth muscle cells, lens, retina and prostatic epithelial cells, oligodendrocytes, astrocytes, chrondocytes, myoblasts and osteoblasts.

Fibroblast growth factors can also stimulate a large number of cell types in a non-mitogenic manner. These activities include promotion of cell migration into wound area (chemotaxis), initiation of new blood vessel formulation (angiogenesis), modulation of nerve regeneration and survival (neurotrophism), modulation of endocrine functions, and stimulation or suppression of specific cellular protein expression, extracellular matrix production and cell survival. Baird & Bohlen, Handbook of Exp. Pharmacol. 95(1): 369418, Springer, (1990). These properties provide a basis for using fibroblast growth factors in therapeutic approaches to accelerate wound healing, nerve repair, collateral blood vessel formation, and the like. For example, fibroblast growth factors have been suggested to minimize myocardium damage in heart disease and surgery (U.S. Pat. No. 4,378,347).

FGF-8, also known as androgen-induced growth factor (AIGF), is a 215 amino acid protein which shares 30-40% sequence homology with the other members of the FGF family. FGF-8 has been proposed to be under androgenic regulation and induction in the mouse mammary carcinoma cell line SC3. Tanaka et al., Proc. Natl. Acad. Sci. USA 89:8928-8932 (1992); Sato et al., J. Steroid Biochem. Molec. Biol. 47:91-98 (1993). As a result, FGF-8 may have a local role in the prostate, which is known to be an androgen-responsive organ. FGF-8 can also be oncogenic, as it displays transforming activity when transfected into NIH-3T3 fibroblasts. Kouhara et al., Oncogene 9 455462 (1994). While FGF-8 has been detected in heart, brain, lung, kidney, testis, prostate and ovary, expression was also detected in the absence of exogenous androgens. Schmitt et al., J. Steroid Biochem. Mol. Biol. (34): 173-78 (1996).

FGF-8 shares the property with several other FGFs of being expressed at a variety of stages of murine embryogenesis, which supports the theory that the various FGFs have multiple and perhaps coordinated roles in differentiation and embryogenesis. Moreover, FGF-8 has also been identified as a protooncogene that cooperates with Wnt-1 in the process of mammary tumorigenesis (Shackleford et al., Proc. Natl. Acad. Sci. USA 90, 740-744 (1993); Heikinheimo et al., Mech. Dev. 48:129-138 (1994)).

In contrast to the other FGFs, FGF-8 exists as three protein isoforms, as a result of alternative splicing of the primary transcript. Tanaka et al., supra. Normal adult expression of FGF-8 is weak and confined to gonadal tissue, however northern blot analysis has indicated that FGF-8 mRNA is present from day 10 through day 12 or murine gestation, which suggests that FGF-8 is important to normal development. Heikinheimo et al., Mech Dev. 48(2): 129-38 (1994). Further in situ hybridization assays between day 8 and 16 of gestation indicated initial expression in the surface ectoderm of the first bronchial arches, the frontonasal process, the forebrain and the midbrain-hindbrain junction. At days 10-12, FGF-8 was expressed in the surface ectoderm of the forelimb and hindlimb buds, the nasal its and nasopharynx, the infundibulum and in the telencephalon, diencephalon and metencephalon. Expression continues in the developing hindlimbs through day 13 of gestation, but is undetectable thereafter. The results suggest that FGF-8 has a unique temporal and spatial pattern in embryogenesis and suggests a role for this growth factor in multiple regions of ectodermal differentiation in the post-gastrulation embryo.

The TGF-beta supergene family, or simply TGF-beta superfamily, a group of secreted proteins, includes a large number of related growth and differentiation factors expressed in virtually all phyla. Superfamily members bind to specific cell surface receptors that activate signal transduction mechanisms to elicit their multifunctional cytokine effects. Kolodziejczyk and Hall, Biochem. Cell. Biol., 74:299-314 (1996); Attisano and Wrana, Cytokine Growth Factor Rev., 7:327-339 (1996); and Hill, Cellular Signaling, 8:533-544 (1996).

Members of this family include five distinct forms of TGF-beta (Sporn and Roberts, in Peptide Growth Factors and Their Receptors, Sporn and Roberts, eds. (Springer-Verlag: Berlin, 1990) pp. 419-472), as well as the differentiation factors vg1 (Weeks and Melton, Cell, 51:861-867 (1987)) and DPP-C polypeptide (Padgett et al., Nature, 325:81-84 (1987)), the hormones activin and inhibin (Mason et al., Nature 318-659-663 (1985); Mason et al., Growth Factors, 1:77-88 (1987)), the Mullerian-inhibiting substance (MIS) (Cate et al., Cell, 45: 685-698 (1986)), the bone morphogenetic proteins (BMPs) (Wozney et al., Science, 242:1528-1534 (1988); PCT WO 88/00205 published Jan. 14, 1988; U.S. Pat. No. 4,877,864 issued Oct. 31, 1989), the developmentally regulated proteins Vgr-1 (Lyons et al., Proc. Natl. Acad. Sci. USA. 86:45544558 (1989)) and Vgr-2 (Jones et al., Molec. Endocrinol., 6:1961-1968 (1992)), the mouse growth differentiation factor (GDF), such as GDF-3 and GDF-9 (Kingsley, Genes Dev., 8:133-146 (1994); McPherron and Lee, J. Biol. Chem., 268:3444-3449 (1993)), the mouse lefty/Stral (Meno et al., Nature, 381:151-155 (1996); Bouillet et al., Dev. Biol., 170: 420-433 (1995)), glial cell line-derived neurotrophic factor (GDNF) (Lin et al., Science, 260:1130-1132 (1993), neurturin (Kotzbauer et al., Nature, 384:467-470 (1996)), and endometrial bleeding-associated factor (EBAF) (Kothapalli et al., J. Clin. Invest., 99:2342-2350 (1997)). The subset BMP-2A and BMP-2B is approximately 75% homologous in sequence to DPP-C and may represent the mammalian equivalent of that protein.

The proteins of the TGF-beta superfamily are disulfide-linked homo- or heterodimers encoded by larger precursor polypeptide chains containing a hydrophobic signal sequence, a long and relatively poorly conserved N-terminal pro region of several hundred amino acids, a cleavage site (usually polybasic), and a shorter and more highly conserved C-terminal region. This C-terminal region corresponds to the processed mature protein and contains approximately 100 amino acids with a characteristic cysteine motif, i.e. the conservation of seven of the nine cysteine residues of TGF-beta among all known family members. Although the position of the cleavage site between the mature and pro regions varies among the family members, the C-terminus of all of the proteins is in the identical position, ending in the sequence Cys-X-Cys-X, but differing in every case from the TGF-beta consensus C-terminus of Cys-Lys-Cys-Ser. Sporn and Roberts, 1990, supra.

There are at least five forms of TGF-beta currently identified, TGF-beta1, TGF-beta2, TGF-beta3, TGF-beta4, and TGF-beta5. The activated form of TGF-beta1 is a homodimer formed by dimerization of the carboxy-terminal 112 amino acids of a 390 amino acid precursor. Recombinant TGF-beta1 has been cloned (Derynck et al., Nature, 316:701-705 (1985)) and expressed in Chinese hamster ovary cells (Gentry et al., Mol. Cell. Biol. 7:3418-3427 (1987)). Additionally, recombinant human TGF-beta2 (deMartin et al., EMBO J., 6:3673 (1987)), as well as human and porcine TGF-beta3 (Derynck et al., EMBO J., 7:3737-3743 (1988); ten Dijke et al., Proc. Natl. Acad. Sci. USA, 85:4715 (1988)) have been cloned. TGF-beta2 has a precursor form of 414 amino acids and is also processed to a homodimer from the carboxy-terminal 112 amino acids that shares approximately 70% homology with the active form of TGF-beta1 (Marquardt et al., J. Biol. Chem., 262:12127 (1987)). See also EP 200,341; 169,016; 268,561; and 267, 463; U.S. Pat. No. 4,774,322; Cheifetz et al., Cell, 48:409-

415 (1987); Jakowlew et al., Molecular Endocrin., 2:747-755 (1988); Derynck et al., J. Biol. Chem., 261:4377-4379 (1986); Sharples et al., DNA, 6:239-244 (1987); Derynck et al., Nucl. Acids. Res., 15:3188-3189 (1987); Derynck et al., Nucl. Acids. Res. 15:3187 (1987); Seyedin et al., J. Biol. Chem., 261:5693-5695 (1986); Madisen et al., DNA 7:1-8 (1988); and Hanks et al., Proc. Natl. Acad. Sci. (U.S.A.), 85:79-82 (1988).

TGF-beta4 and TGF-beta5 were cloned from a chicken chondrocyte cDNA library (Jakowlew et al., Molec. Endocrinol., 2:1186-1195 (1988)) and from a frog oocyte cDNA library, respectively.

The pro region of TGF-beta associates non-covalently with the mature TGF-beta dimer (Wakefield et al., J. Biol. Chem., 263:7646-7654 (1988); Wakefield et al., Growth Factors, 1:203-218 (1989)), and the pro regions are found to be necessary for proper folding and secretion of the active mature dimers of both TGF-beta and activin (Gray and Mason, Science, 247:1328-1330 (1990)). The association between the mature and pro regions of TGF-beta masks the biological activity of the mature dimer, resulting in formation of an inactive latent form. Latency is not a constant of the TGF-beta superfamily, since the presence of the pro region has no effect on activin or inhibin biological activity.

A unifying feature of the biology of the proteins from the TGF-beta superfamily is their ability to regulate developmental processes. TGF-beta has been shown to have numerous regulatory actions on a wide variety of both normal and neoplastic cells. TGF-beta is multifunctional, as it can either stimulate or inhibit cell proliferation, differentiation, and other critical processes in cell function (Sporn and Roberts, supra).

One member of the TGF-beta superfamily, EBAF, is expressed in endometrium only in the late secretory phase and during abnormal endometrial bleeding. Kothapalli et al., J. Clin. Invest., 99:2342-2350 (1997). Human endometrium is unique in that it is the only tissue in the body that bleeds at regular intervals. In addition, abnormal endometrial bleeding is one of the most common manifestations of gynecological diseases, and is a prime indication for hysterectomy. In situ hybridization showed that the mRNA of EBAF was expressed in the stroma without any significant mRNA expression in the endometrial glands or endothelial cells.

The predicted protein sequence of EBAF showed a strong homology to the protein encoded by mouse lefty/stra3 of the TGF-beta superfamily. A motif search revealed that the predicted EBAF protein contains most of the cysteine residues which are conserved among the TGF-beta-related proteins and which are necessary for the formation of the cysteine knot structure. The EBAF sequence contains an additional cysteine residue, 12 amino acids upstream from the first conserved cysteine residue. The only other family members known to contain an additional cysteine residue are TGF-betas, inhibins, and GDF-3. EBAF, similar to LEFTY, GDF-3/Vgr2, and GDF-9, lacks the cysteine residue that is known to form the intermolecular disulfide bond. Therefore, EBAF appears to be an additional member of the TGF-beta superfamily with an unpaired cysteine residue that may not exist as a dimer. However, hydrophobic contacts between the two monomer subunits may promote dimer formation. Fluorescence in situ hybridization showed that the ebaf gene is located on human chromosome 1 at band q42.1.

Further examples of such extracellular proteins are well known in the art, for example see U.S. Pat. No. 6,723,535.

Conjugates

The invention also pertains to conjugates of symmtroadhesins/immunosymmetroadhesins. Thus the instant compositions can be conjugated to a cytotoxic agent such as a chemotherapeutic agent, toxin (e.g., an enzymatically active toxin of bacterial, fungal, plant, or animal origin, or fragments thereof), or a radioactive isotope (i.e., a radioconjugate).

Chemotherapeutic agents useful in the generation of such immunoconjugates are well known in the art. Enzymatically active toxins and fragments thereof that can be used include diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), *Momordica charantia* inhibitor, curcin, crotin, *Sapaonaria officinalis* inhibitor, gelonin, mitogellin, restrictocin, phenomycin, enomycin, and the tricothecenes. A variety of radionuclides are available for the production of radioconjugated antibodies. Examples include $^{212}$Bi, $^{131}$I, $^{113}$In, $^{90}$Y, and $^{186}$Re.

Conjugates of the compositions of the invention including cytotoxic agent are made using a variety of bifunctional protein-coupling agents such as N-succinimidyl-3-(2-pyridyldithiol) propionate (SPDP), iminothiolane (IT), bifunctional derivatives of imidoesters (such as dimethyl adipimidate HCL), active esters (such as disuccinimidyl suberate), aldehydes (such as glutareldehyde), bis-azido compounds (such as bis (p-azidobenzoyl) hexanediamine), bis-diazonium derivatives (such as bis-(p-diazoniumbenzoyl)-ethylenediamine), diisocyanates (such as tolyene 2,6-diisocyanate), and bis-active fluorine compounds (such as 1,5-difluoro-2,4-dinitrobenzene). For example, a ricin immunotoxin can be prepared as described in Vitetta et al., Science, 238:1098 (1987). Carbon-14-labeled 1-isothiocyanatobenzyl-3-methyldiethylene triaminepentaacetic acid (MX-DTPA) is an exemplary chelating agent for conjugation of radionucleotide to the antibody. See WO94111026.

Synthesis of Genetic Devices

The genetic devices disclosed herein may be synthesized by various routes. One particular route is to synthesize components in vivo by recombinant DNA technology and then to chemically modify the secreted or procured products under conditions so as to form the compounds. Alternative routes include solid-state synthesis.

General Techniques

The description below relates primarily to production of stretches of consecutive amino acids or polypeptides of interest by culturing cells transformed or transfected with a vector containing an encoding nucleic acid. It is, of course, contemplated that alternative methods, which are well known in the art, may be employed. For instance, the amino acid sequence, or portions thereof, may be produced by direct peptide synthesis using solid-phase techniques (see, e.g., Stewart et al., Solid-Phase Peptide Synthesis, W.H. Freeman Co., San Francisco, Calif. (1969); Merrifield, J. Am. Chem. Soc., 85:2149-2159 (1963)). In vitro protein synthesis may be performed using manual techniques or by automation. Automated synthesis may be accomplished, for instance, using an Applied Biosystems Peptide Synthesizer (Foster City, Calif.) using manufacturer's instructions. Various portions of the stretches of consecutive amino acids or polypeptides of interest may be chemically synthesized separately and combined using chemical or enzymatic methods to produce the full-length stretches of consecutive amino acids or polypeptides of interest.

1. Isolation of DNA Encoding Stretches of Consecutive Amino Acids or Polypeptides of Interest Encoding DNA may be obtained from a cDNA library prepared from tissue believed to possess the mRNA of interest and to express it at a detectable level. Accordingly, human DNA can be conveniently obtained from a cDNA library prepared from human tissue, and so forth. An encoding gene may also be obtained from a genomic library or by known synthetic procedures (e.g., automated nucleic acid synthesis).

Libraries can be screened with probes (such as antibodies to the stretch of consecutive amino acids or oligonucleotides of at least about 20-80 bases) designed to identify the gene of interest or the protein encoded by it. Screening the cDNA or genomic library with the selected probe may be conducted using standard procedures, such as described in Sambrook et al., Molecular Cloning: A Laboratory Manual (New York: Cold Spring Harbor Laboratory Press, 1989). An alternative means to isolate the encoding gene is to use PCR methodology (Sambrook et al., supra; Dieffenbach et al., PCR Primer: A Laboratory Manual (Cold Spring Harbor Laboratory Press, 1995)).

The oligonucleotide sequences selected as probes should be of sufficient length and sufficiently unambiguous that false positives are minimized. The oligonucleotide is preferably labeled such that it can be detected upon hybridization to DNA in the library being screened. Methods of labeling are well known in the art, and include the use of radiolabels like $^{32}$P-labeled ATP, biotinylation or enzyme labeling. Hybridization conditions, including moderate stringency and high stringency, are provided in Sambrook et al., supra.

Sequences identified in such library screening methods can be compared and aligned to other known sequences deposited and available in public databases such as GenBank or other private sequence databases. Sequence identity (at either the amino acid or nucleotide level) within defined regions of the molecule or across the full-length sequence can be determined using methods known in the art and as described herein.

Nucleic acid having protein coding sequence may be obtained by screening selected cDNA or genomic libraries using the deduced amino acid sequence disclosed herein for the first time, and, if necessary, using conventional primer extension procedures as described in Sambrook et al., supra, to detect precursors and processing intermediates of mRNA that may not have been reverse-transcribed into cDNA.

2. Selection and Transformation of Host Cells

Host cells are transfected or transformed with expression or cloning vectors described herein for production and cultured in conventional nutrient media modified as appropriate for inducing promoters, selecting transformants, or amplifying the genes encoding the desired sequences. The culture conditions, such as media, temperature, pH and the like, can be selected by the skilled artisan without undue experimentation. In general, principles, protocols, and practical techniques for maximizing the productivity of cell cultures can be found in Mammalian Cell Biotechnology: a Practical Approach, M. Butler, ed. (IRL Press, 1991) and Sambrook et al., supra.

Methods of eukaryotic cell transfection and prokaryotic cell transformation are known to the ordinarily skilled artisan, for example, $CaCl_2$, $CaPO_4$, liposome-mediated and electroporation. Depending on the host cell used, transformation is performed using standard techniques appropriate to such cells. The calcium treatment employing calcium chloride, as described in Sambrook et al., supra, or electroporation is generally used for prokaryotes. Infection with *Agrobacterium tumefaciens* is used for transformation of certain plant cells, as described by Shaw et al., Gene, 23:315 (1983) and WO 89/05859 published Jun. 29, 1989. For mammalian cells without such cell walls, the calcium phosphate precipitation method of Graham and van der Eb, Virology, 52:456-457 (1978) can be employed. General aspects of mammalian cell host system transfections have been described in U.S. Pat. No. 4,399,216. Transformations into yeast are typically carried out according to the method of Van Solingen et al., J. Bact., 130:946 (1977) and Hsiao et al., Proc. Natl. Acad. Sci. (USA), 76:3829 (1979). However, other methods for introducing DNA into cells, such as by nuclear microinjection, electroporation, bacterial protoplast fusion with intact cells, or polycations, e.g., polybrene, polyornithine, may also be used. For various techniques for transforming mammalian cells, see Keown et al., Methods in Enzymology, 185:527-537 (1990) and Mansour et al., Nature, 336:348-352 (1988).

Suitable host cells for cloning or expressing the DNA in the vectors herein include prokaryote, yeast, or higher eukaryote cells. Suitable prokaryotes include but are not limited to eubacteria, such as Gram-negative or Gram-positive organisms, for example, Enterobacteriaceae such as *E. coli*. Various *E. coli* strains are publicly available, such as *E. coli* K12 strain MM294 (ATCC 31,446); *E. coli* X1776 (ATCC 31,537); *E. coli* strain W3110 (ATCC 27,325) and K5772 (ATCC 53,635). Other suitable prokaryotic host cells include Enterobacteriaceae such as *Escherichia*, e.g., *E. coli*, *Enterobacter*, *Erwinia*, *Klebsiella*, *Proteus*, *Salmonella*, e.g., *Salmonella typhimurium*, *Serratia*, e.g., *Serratia marcescans*, and *Shigella*, as well as Bacilli such as *B. subtilis* and *B. licheniformis* (e.g., *B. licheniformis* 41P disclosed in DD 266,710 published Apr. 12, 1989), *Pseudomonas* such as *P. aeruginosa*, and *Streptomyces*. These examples are illustrative rather than limiting. Strain W3110 is one particularly preferred host or parent host because it is a common host strain for recombinant DNA product fermentations. Preferably, the host cell secretes minimal amounts of proteolytic enzymes. For example, strain W3110 may be modified to effect a genetic mutation in the genes encoding proteins endogenous to the host, with examples of such hosts including *E. coli* W3110 strain 1A2, which has the complete genotype tonA; *E. coli* W3110 strain 9E4, which has the complete genotype tonA ptr3; *E. coli* W3110 strain 2707 (ATCC 55,244), which has the complete genotype tonAptr3phoA E15 (argF-lac)169 degP ompT kan.sup.r; *E. coli* W3110 strain 37D6, which has the complete genotype tonA ptr3 phoA E15 (argF-lac)169 degP ompT rbs7 ilvG kan.sup.r, *E. coli* W3110 strain 4084, which is strain 37D6 with a non-kanamycin resistant degP deletion mutation; and an *E. coli* strain having mutant periplasmic protease disclosed in U.S. Pat. No. 4,946,783 issued Aug. 7, 1990. Alternatively, in vitro methods of cloning, e.g., PCR or other nucleic acid polymerase reactions, are suitable.

In addition to prokaryotes, eukaryotic microbes such as filamentous fungi or yeast are suitable cloning or expression hosts for encoding vectors. *Saccharomyces cerevisiae* is a commonly used lower eukaryotic host microorganism. Others include *Schizosaccharomyces pombe* (Beach and Nurse, Nature, 290:140 (1981); EP 139,383 published May 2, 1985); *Kluyveromyces* hosts (U.S. Pat. No. 4,943,529; Fleer et al., Bio/Technology, 9:968-975 (1991)) such as, e.g., *K. lactis* (MW98-8C, CBS683, CBS4574; Louvencourt et al., J. Bacteriol., 737 (1983)), *K. fragilis* (ATCC 12,424), *K. bulgaricus* (ATCC 16,045), *K. wickeramii* (ATCC 24,178), *K. waltii* (ATCC 56,500), *K. drosophilarum* (ATCC 36,906;

Van den Berg et al., Bio/Technology, 8:135 (1990)), *K. thermotolerans*, and *K. marxianus; yarrowia* (EP 402,226); *Pichia pastoris* (EP 183,070; Sreekrishna et al., J. Basic Microbiol., 28:265-278 (1988)); *Candida; Trichoderma reesia* (EP 244,234); *Neurospora crassa* (Case et al., Proc. Natl. Acad. Sci. USA, 76:5259-5263 (1979)); *Schwanniomyces* such as *Schwanniomyces occidentalis* (EP 394,538 published Oct. 31, 1990); and filamentous fungi such as, e.g., *Neurospora, Penicillium, Tolypocladium* (WO 91/00357 published Jan. 10, 1991), and *Aspergillus* hosts such as *A. nidulans* (Ballance et al., Biochem. Biophys. Res. Commun., 112:284-289 (1983); Tilburn et al., Gene, 26:205-221 (1983); Yelton et al., Proc. Natl. Acad. Sci. USA, 81:1470-1474 (1984)) and *A. niger* (Kelly and Hynes, EMBO J., 4:475479 (1985)). Methylotropic yeasts are suitable herein and include, but are not limited to, yeast capable of growth on methanol selected from the genera consisting of *Hansenula, Candida, Kloeckera, Pichia, Saccharomyces, Torulopsis*, and *Rhodotorula*. A list of specific species that are exemplary of this class of yeasts may be found in C. Anthony, The Biochemistry of Methylotrophs, 269 (1982).

Suitable host cells for the expression of glycosylated stretches of consecutive amino acids or polypeptides of interest are derived from multicellular organisms. Examples of invertebrate cells include insect cells such as *Drosophila* S2 and *Spodoptera* Sf9, as well as plant cells. Examples of useful mammalian host cell lines include Chinese hamster ovary (CHO) and COS cells. More specific examples include monkey kidney CV1 line transformed by SV40 (COS-7, ATCC CRL 1651); human embryonic kidney line (293 or 293 cells subcloned for growth in suspension culture, Graham et al., J. Gen Virol., 36:59 (1977)); Chinese hamster ovary cells/–DHFR (CHO, Urlaub and Chasin, Proc. Natl. Acad. Sci. USA, 77:4216 (1980)); mouse sertoli cells (TM4, Mather, Biol. Reprod., 23:243-251 (1980)); human lung cells (W138, ATCC CCL 75); human liver cells (Hep G2, HB 8065); and mouse mammary tumor (MMT 060562, ATCC CCL51). The selection of the appropriate host cell is deemed to be within the skill in the art.

3. Selection and Use of a Replicable Vector

The nucleic acid (e.g., cDNA or genomic DNA) encoding the stretch of consecutive amino acids or polypeptides of interest may be inserted into a replicable vector for cloning (amplification of the DNA) or for expression. Various vectors are publicly available. The vector may, for example, be in the form of a plasmid, cosmid, viral particle, or phage. The appropriate nucleic acid sequence may be inserted into the vector by a variety of procedures. In general, DNA is inserted into an appropriate restriction endonuclease site(s) using techniques known in the art. Vector components generally include, but are not limited to, one or more of a signal sequence, an origin of replication, one or more marker genes, an enhancer element, a promoter, and a transcription termination sequence. Construction of suitable vectors containing one or more of these components employs standard ligation techniques which are known to the skilled artisan.

The stretches of consecutive amino acids or polypeptides of interest may be produced recombinantly not only directly, but also as a fusion polypeptide with a heterologous polypeptide, which may be a signal sequence or other polypeptide having a specific cleavage site at the N-terminus of the mature protein or polypeptide. In general, the signal sequence may be a component of the vector, or it may be a part of the encoding DNA that is inserted into the vector. The signal sequence may be a prokaryotic signal sequence selected, for example, from the group of the alkaline phosphatase, penicillinase, 1pp, or heat-stable enterotoxin II leaders. For yeast secretion the signal sequence may be, e.g., the yeast invertase leader, alpha factor leader (including *Saccharomyces* and *Kluyveromyces* alpha-factor leaders, the latter described in U.S. Pat. No. 5,010,182), or acid phosphatase leader, the *C. albicans* glucoamylase leader (EP 362,179 published Apr. 4, 1990), or the signal described in WO 90/13646 published Nov. 15, 1990. In mammalian cell expression, mammalian signal sequences may be used to direct secretion of the protein, such as signal sequences from secreted polypeptides of the same or related species, as well as viral secretory leaders.

Both expression and cloning vectors contain a nucleic acid sequence that enables the vector to replicate in one or more selected host cells. Such sequences are well known for a variety of bacteria, yeast, and viruses. The origin of replication from the plasmid pBR322 is suitable for most Gram-negative bacteria, the 2mu plasmid origin is suitable for yeast, and various viral origins (SV40, polyoma, adenovirus, VSV or BPV) are useful for cloning vectors in mammalian cells.

Expression and cloning vectors will typically contain a selection gene, also termed a selectable marker. Typical selection genes encode proteins that (a) confer resistance to antibiotics or other toxins, e.g., ampicillin, neomycin, methotrexate, or tetracycline, (b) complement auxotrophic deficiencies, or (c) supply critical nutrients not available from complex media, e.g., the gene encoding D-alanine racemase for Bacilli.

An example of suitable selectable markers for mammalian cells are those that enable the identification of cells competent to take up the encoding nucleic acid, such as DHFR or thymidine kinase. An appropriate host cell when wild-type DHFR is employed is the CHO cell line deficient in DHFR activity, prepared and propagated as described by Urlaub et al., Proc. Natl. Acad. Sci. USA, 77:4216 (1980). A suitable selection gene for use in yeast is the trp1 gene present in the yeast plasmid YRp7 (Stinchcomb et al., Nature, 282:39 (1979); Kingsman et al., Gene, 7:141 (1979); Tschemper et al., Gene, 10:157 (1980)). The trp1 gene provides a selection marker for a mutant strain of yeast lacking the ability to grow in tryptophan, for example, ATCC No. 44076 or PEP4-1 (Jones, Genetics, 85:12 (1977)).

Expression and cloning vectors usually contain a promoter operably linked to the encoding nucleic acid sequence to direct mRNA synthesis. Promoters recognized by a variety of potential host cells are well known. Promoters suitable for use with prokaryotic hosts include the beta-lactamase and lactose promoter systems (Chang et al., Nature, 275:615 (1978); Goeddel et al., Nature, 281:544 (1979)), alkaline phosphatase, a tryptophan (trp) promoter system (Goeddel, Nucleic Acids Res., 8:4057 (1980); EP 36,776), and hybrid promoters such as the tac promoter (deBoer et al., Proc. Natl. Acad. Sci. USA, 80:21-25 (1983)). Promoters for use in bacterial systems also will contain a Shine-Dalgarno (S.D.) sequence operably linked to the encoding DNA.

Examples of suitable promoting sequences for use with yeast hosts include the promoters for 3-phosphoglycerate kinase (Hitzeman et al., J. Biol. Chem., 255:2073 (1980)) or other glycolytic enzymes (Hess et al., J. Adv. Enzyme Re.g., 7:149 (1968); Holland, Biochemistry, 17:4900 (1978)), such as enolase, glyceraldehyde-3-phosphate dehydrogenase, hexokinase, pyruvate decarboxylase, phosphofructokinase, glucose-6-phosphate isomerase, 3-phosphoglycerate mutase, pyruvate kinase, triosephosphate isomerase, phosphoglucose isomerase, and glucokinase.

Other yeast promoters, which are inducible promoters having the additional advantage of transcription controlled by growth conditions, are the promoter regions for alcohol dehydrogenase 2, isocytochrome C, acid phosphatase, degradative enzymes associated with nitrogen metabolism, metallothionein, glyceraldehyde-3-phosphate dehydrogenase, and enzymes responsible for maltose and galactose utilization. Suitable vectors and promoters for use in yeast expression are further described in EP 73,657.

Transcription from vectors in mammalian host cells is controlled, for example, by promoters obtained from the genomes of viruses such as polyoma virus, fowlpox virus (UK 2,211,504 published Jul. 5, 1989), adenovirus (such as Adenovirus 2), bovine papilloma virus, avian sarcoma virus, cytomegalovirus, a retrovirus, hepatitis-B virus and Simian Virus 40 (SV40), from heterologous mammalian promoters, e.g., the actin promoter or an immunoglobulin promoter, and from heat-shock promoters, provided such promoters are compatible with the host cell systems.

Transcription of a DNA encoding the stretches of consecutive amino acids or polypeptides of interest by higher eukaryotes may be increased by inserting an enhancer sequence into the vector. Enhancers are cis-acting elements of DNA, usually about from 10 to 300 bp, that act on a promoter to increase its transcription. Many enhancer sequences are now known from mammalian genes (globin, elastase, albumin, alpha-fetoprotein, and, insulin). Typically, however, one will use an enhancer from a eukaryotic cell virus. Examples include the SV40 enhancer on the late side of the replication origin (bp 100-270), the cytomegalovirus early promoter enhancer, the polyoma enhancer on the late side of the replication origin, and adenovirus enhancers. The enhancer may be spliced into the vector at a position 5' or 3' to the coding sequence, but is preferably located at a site 5' from the promoter.

Expression vectors used in eukaryotic host cells (yeast, fungi, insect, plant, animal, human, or nucleated cells from other multicellular organisms) will also contain sequences necessary for the termination of transcription and for stabilizing the mRNA. Such sequences are commonly available from the 5' and, occasionally 3', untranslated regions of eukaryotic or viral DNAs or cDNAs. These regions contain nucleotide segments transcribed as polyadenylated fragments in the untranslated portion of the mRNA encoding stretches of consecutive amino acids or polypeptides of interest.

Still other methods, vectors, and host cells suitable for adaptation to the synthesis of stretches of consecutive amino acids or polypeptides in recombinant vertebrate cell culture are described in Gething et al., Nature 293:620-625 (1981); Mantei et al., Nature, 281:4046 (1979); EP 117,060; and EP 117,058.

4. Detecting Gene Amplification/Expression

Gene amplification and/or expression may be measured in a sample directly, for example, by conventional Southern blotting, Northern blotting to quantitate the transcription of mRNA (Thomas, Proc. Natl. Acad. Sci. USA, 77:5201-5205 (1980)), dot blotting (DNA analysis), or in situ hybridization, using an appropriately labeled probe, based on the sequences provided herein. Alternatively, antibodies may be employed that can recognize specific duplexes, including DNA duplexes, RNA duplexes, and DNA-RNA hybrid duplexes or DNA-protein duplexes. The antibodies in turn may be labeled and the assay may be carried out where the duplex is bound to a surface, so that upon the formation of duplex on the surface, the presence of antibody bound to the duplex can be detected.

Gene expression, alternatively, may be measured by immunological methods, such as immunohistochemical staining of cells or tissue sections and assay of cell culture or body fluids, to quantitate directly the expression of gene product. Antibodies useful for immunohistochemical staining and/or assay of sample fluids may be either monoclonal or polyclonal, and may be prepared in any mammal. Conveniently, the antibodies may be prepared against a native sequence stretches of consecutive amino acids or polypeptides of interest or against a synthetic peptide based on the DNA sequences provided herein or against exogenous sequence fused to DNA encoding a stretch of consecutive amino acids or polypeptide of interest and encoding a specific antibody epitope.

5. Purification of Polypeptide

Forms of the stretches of consecutive amino acids or polypeptides of interest may be recovered from culture medium or from host cell lysates. If membrane-bound, it can be released from the membrane using a suitable detergent solution (e.g. Triton-X 100) or by enzymatic cleavage. Cells employed in expression of the stretches of consecutive amino acids or polypeptides of interest can be disrupted by various physical or chemical means, such as freeze-thaw cycling, sonication, mechanical disruption, or cell lysing agents.

It may be desired to purify the stretches of consecutive amino acids or polypeptides of interest from recombinant cell proteins or polypeptides. The following procedures are exemplary of suitable purification procedures: by fractionation on an ion-exchange column; ethanol precipitation; reverse phase HPLC; chromatography on silica or on a cation-exchange resin such as DEAE; chromatofocusing; SDS-PAGE; ammonium sulfate precipitation; gel filtration using, for example, Sephadex G-75; protein A Sepharose columns to remove contaminants such as IgG; and metal chelating columns to bind epitope-tagged forms. Various methods of protein purification may be employed and such methods are known in the art and described for example in Deutscher, Methods in Enzymology, 182 (1990); Scopes, Protein Purification: Principles and Practice, Springer-Verlag, New York (1982). The purification step(s) selected will depend, for example, on the nature of the production process used and the particular stretches of consecutive amino acids or polypeptides of interest produced.

Example of Expression of Stretch of Consecutive Amino Acids or Polypeptide Component of Interest in E. coli The DNA sequence encoding the desired amino acid sequence of interest or polypeptide is initially amplified using selected PCR primers. The primers should contain restriction enzyme sites which correspond to the restriction enzyme sites on the selected expression vector. A variety of expression vectors may be employed. An example of a suitable vector is pBR322 (derived from E. coli; see Bolivar et al., Gene, 2:95 (1977)) which contains genes for ampicillin and tetracycline resistance. The vector is digested with restriction enzyme and dephosphorylated. The PCR amplified sequences are then ligated into the vector. The vector will preferably include sequences which encode for an antibiotic resistance gene, a trp promoter, a polyhis leader (including the first six STII codons, polyhis sequence, and enterokinase cleavage site), the specific amino acid sequence of interest/polypeptide coding region, lambda transcriptional terminator, and an argU gene.

The ligation mixture is then used to transform a selected E. coli strain using the methods described in Sambrook et al., supra. Transformants are identified by their ability to grow on LB plates and antibiotic resistant colonies are then selected. Plasmid DNA can be isolated and confirmed by restriction analysis and DNA sequencing.

Selected clones can be grown overnight in liquid culture medium such as LB broth supplemented with antibiotics. The overnight culture may subsequently be used to inoculate a larger scale culture. The cells are then grown to a desired optical density, during which the expression promoter is turned on.

After culturing the cells for several more hours, the cells can be harvested by centrifugation. The cell pellet obtained by the centrifugation can be solubilized using various agents known in the art, and the solubilized amino acid sequence of interest or polypeptide can then be purified using a metal chelating column under conditions that allow tight binding of the protein.

The primers can contain restriction enzyme sites which correspond to the restriction enzyme sites on the selected expression vector, and other useful sequences providing efficient and reliable translation initiation, rapid purification on a metal chelation column, and proteolytic removal with enterokinase. The PCR-amplified, poly-His tagged sequences can be ligated into an expression vector used to transform an *E. coli* host based on, for example, strain 52 (W3110 fuhA(tonA) lon galE rpoHts(htpRts) clpP(lacIq). Transformants can first be grown in LB containing 50 mg/ml carbenicillin at 30° C. with shaking until an O.D.600 of 3-5 is reached. Cultures are then diluted 50-100 fold into C RAP media (prepared by mixing 3.57 g $(NH_4)_2 SO_4$, 0.71 g sodium citrate-$2H_2O$, 1.07 g KCl, 5.36 g Difco yeast extract, 5.36 g Sheffield hycase SF in 500 mL water, as well as 110 mM MPOS, pH 7.3, 0.55% (w/v) glucose and 7 mM $MgSO_4$) and grown for approximately 20-30 hours at 30° C. with shaking. Samples were removed to verify expression by SDS-PAGE analysis, and the bulk culture is centrifuged to pellet the cells. Cell pellets were frozen until purification and refolding.

*E. coli* paste from 0.5 to 1 L fermentations (6-10 g pellets) was resuspended in 10 volumes (w/v) in 7 M guanidine, 20 mM Tris, pH 8 buffer. Solid sodium sulfite and sodium tetrathionate is added to make final concentrations of 0.1M and 0.02 M, respectively, and the solution was stirred overnight at 4° C. This step results in a denatured protein with all cysteine residues blocked by sulfitolization. The solution was centrifuged at 40,000 rpm in a Beckman Ultracentifuge for 30 min. The supernatant was diluted with 3-5 volumes of metal chelate column buffer (6 M guanidine, 20 mM Tris, pH 7.4) and filtered through 0.22 micron filters to clarify. Depending the clarified extract was loaded onto a 5 mil Qiagen Ni-NTA metal chelate column equilibrated in the metal chelate column buffer. The column was washed with additional buffer containing 50 mM imidazole (Calbiochem, Utrol grade), pH 7.4. The protein was eluted with buffer containing 250 mM imidazole. Fractions containing the desired protein were pooled and stored at 4.degree. C. Protein concentration was estimated by its absorbance at 280 nm using the calculated extinction coefficient based on its amino acid sequence.

Expression of Consecutive Stretches of Amino Acids in Mammalian Cells

This general example illustrates a preparation of a glycosylated form of a desired amino acid sequence of interest or polypeptide component by recombinant expression in mammalian cells.

The vector pRK5 (see EP 307,247, published Mar. 15, 1989) can be employed as the expression vector. Optionally, the encoding DNA is ligated into pRK5 with selected restriction enzymes to allow insertion of the DNA using ligation methods such as described in Sambrook et al., supra.

In one embodiment, the selected host cells may be 293 cells. Human 293 cells (ATCC CCL 1573) are grown to confluence in tissue culture plates in medium such as DMEM supplemented with fetal calf serum and optionally, nutrient components and/or antibiotics. About 10 μg of the ligated vector DNA is mixed with about 1 μg DNA encoding the VA RNA gene [Thimmappaya et al., Cell 31:543 (1982)] and dissolved in 500 μl of I mM Tris-HCl, 0.1 mM EDTA, 0.227 M $CaCl_2$ To this mixture is added, dropwise, 500 μl of 50 mM HEPES (pH 7.35), 280 mM NaCl, 1.5 mM $NaPO_4$, and a precipitate is allowed to form for 10 minutes at 25° C. The precipitate is suspended and added to the 293 cells and allowed to settle for about four hours at 37° C. The culture medium is aspirated off and 2 ml of 20% glycerol in PBS is added for 30 seconds. The 293 cells are then washed with serum free medium, fresh medium is added and the cells are incubated for about 5 days.

Approximately 24 hours after the transfections, the culture medium is removed and replaced with culture medium (alone) or culture medium containing 200 μCi/ml $^{35}S$-cysteine and 200 μCi/ml $^{35}S$-methionine. After a 12 hour incubation, the conditioned medium is collected, concentrated on a spin filter, and loaded onto a 15% SDS gel. The processed gel may be dried and exposed to film for a selected period of time to reveal the presence of amino acid sequence of interest or polypeptide component. The cultures containing transfected cells may undergo further incubation (in serum free medium) and the medium is tested in selected bioassays.

In an alternative technique, the nucleic acid amino acid sequence of interest or polypeptide component may be introduced into 293 cells transiently using the dextran sulfate method described by Somparyrac et al., Proc. Natl. Acad. Sci., 12:7575 (1981). 293 cells are grown to maximal density in a spinner flask and 700 μg of the ligated vector is added. The cells are first concentrated from the spinner flask by centrifugation and washed with PBS. The DNA-dextran precipitate is incubated on the cell pellet for four hours. The cells are treated with 20% glycerol for 90 seconds, washed with tissue culture medium, and re-introduced into the spinner flask containing tissue culture medium, 5 μg/ml bovine insulin and 0.1 μg/ml bovine transferrin. After about four days, the conditioned media is centrifuged and filtered to remove cells and debris. The sample containing expressed amino acid sequence of interest or polypeptide component can then be concentrated and purified by any selected method, such as dialysis and/or column chromatography.

In another embodiment, the amino acid sequence of interest or polypeptide component can be expressed in CHO cells. The amino acid sequence of interest or polypeptide component can be transfected into CHO cells using known reagents such as $CaPO_4$ or DEAE-dextran. As described above, the cell cultures can be incubated, and the medium replaced with culture medium (alone) or medium containing a radiolabel such as $^{35}S$-methionine. After determining the presence of amino acid sequence of interest or polypeptide component, the culture medium may be replaced with serum free medium. Preferably, the cultures are incubated for about 6 days, and then the conditioned medium is harvested. The medium containing the expressed amino acid sequence of interest or polypeptide component can then be concentrated and purified by any selected method.

Epitope-tagged amino acid sequence of interest or polypeptide component may also be expressed in host CHO cells. The amino acid sequence of interest or polypeptide component may be subcloned out of a pRK5 vector. The subclone insert can undergo PCR to fuse in frame with a selected epitope tag such as a poly-his tag into a Baculovirus expression vector. The poly-his tagged amino acid sequence of interest or polypeptide component insert can then be subcloned into a SV40 driven vector containing a selection marker such as DHFR for selection of stable clones. Finally, the CHO cells can be transfected (as described above) with the SV40 driven vector. Labeling may be performed, as described above, to verify expression. The culture medium containing the expressed poly-His tagged amino acid sequence of interest or polypeptide component can then be concentrated and purified by any selected method, such as by $Ni^{2+}$-chelate affinity chromatography.

In an embodiment the amino acid sequence of interest or polypeptide component are expressed as an IgG construct (immunoadhesin), in which the coding sequences for the soluble forms (e.g. extracellular domains) of the respective proteins are fused to an IgG1 constant region sequence containing the hinge, CH2 and CH2 domains and/or is a poly-His tagged form.

Following PCR amplification, the respective DNAs are subcloned in a CHO expression vector using standard techniques as described in Ausubel et al., Current Protocols of Molecular Biology, Unit 3.16, John Wiley and Sons (1997). CHO expression vectors are constructed to have compatible restriction sites 5' and 3' of the DNA of interest to allow the convenient shuttling of cDNA's. The vector used in expression in CHO cells is as described in Lucas et al., Nucl. Acids Res. 24:9 (1774-1779 (1996), and uses the SV40 early promoter/enhancer to drive expression of the cDNA of interest and dihydrofolate reductase (DHFR). DHFR expression permits selection for stable maintenance of the plasmid following transfection.

Expression of Stretch of Consecutive Amino Acids in Yeast

The following method describes recombinant expression of a desired amino acid sequence of interest or polypeptide component in yeast.

First, yeast expression vectors are constructed for intracellular production or secretion of a stretch of consecutive amino acids from the ADH2/GAPDH promoter. DNA encoding a desired amino acid sequence of interest or polypeptide component, a selected signal peptide and the promoter is inserted into suitable restriction enzyme sites in the selected plasmid to direct intracellular expression of the amino acid sequence of interest or polypeptide component. For secretion, DNA encoding the stretch of consecutive amino acids can be cloned into the selected plasmid, together with DNA encoding the ADH2/GAPDH promoter, the yeast alpha-factor secretory signal/leader sequence, and linker sequences (if needed) for expression of the stretch of consecutive amino acids.

Yeast cells, such as yeast strain AB110, can then be transformed with the expression plasmids described above and cultured in selected fermentation media. The transformed yeast supernatants can be analyzed by precipitation with 10% trichloroacetic acid and separation by SDS-PAGE, followed by staining of the gels with Coomassie Blue stain.

Recombinant amino acid sequence of interest or polypeptide component can subsequently be isolated and purified by removing the yeast cells from the fermentation medium by centrifugation and then concentrating the medium using selected cartridge filters. The concentrate containing the amino acid sequence of interest or polypeptide component may further be purified using selected column chromatography resins.

Expression of Stretches of Consecutive Amino Acids in Baculovirus-Infected Insect Cells The following method describes recombinant expression of stretches of consecutive amino acids in Baculovirus-infected insect cells.

The desired nucleic acid encoding the stretch of consecutive amino acids is fused upstream of an epitope tag contained with a baculovirus expression vector. Such epitope tags include poly-his tags and immunoglobulin tags (like Fc regions of IgG). A variety of plasmids may be employed, including plasmids derived from commercially available plasmids such as pVL1393 (Novagen). Briefly, the amino acid sequence of interest or polypeptide component or the desired portion of the amino acid sequence of interest or polypeptide component (such as the sequence encoding the extracellular domain of a transmembrane protein) is amplified by PCR with primers complementary to the 5' and 3' regions. The 5' primer may incorporate flanking (selected) restriction enzyme sites. The product is then digested with those selected restriction enzymes and subcloned into the expression vector.

Recombinant baculovirus is generated by co-transfecting the above plasmid and BaculoGold™ virus DNA (Pharmingen) into *Spodoptera frugiperda* ("Sf9") cells (ATCC CRL 1711) using lipofectin (commercially available from GIBCO-BRL). After 4-5 days of incubation at 28° C., the released viruses are harvested and used for further amplifications. Viral infection and protein expression is performed as described by O'Reilley et al., Baculovirus expression vectors: A laboratory Manual, Oxford: Oxford University Press (1994).

Expressed poly-his tagged amino acid sequence of interest or polypeptide component can then be purified, for example, by $Ni^{2+}$-chelate affinity chromatography as follows. Extracts are prepared from recombinant virus-infected Sf9 cells as described by Rupert et al., Nature, 362:175-179 (1993). Briefly, Sf9 cells are washed, resuspended in sonication buffer (25 mL Hepes, pH 7.9; 12.5 mM $MgCl_2$; 0.1 mM EDTA; 10% Glycerol; 0.1% NP40; 0.4 M KCl), and sonicated twice for 20 seconds on ice. The sonicates are cleared by centrifugation, and the supernatant is diluted 50-fold in loading buffer (50 mM phosphate, 300 mM NaCl, 10% Glycerol, pH 7.8) and filtered through a 0.45 μm filter. A $Ni^{2+}$-NTA agarose column (commercially available from Qiagen) is prepared with a bed volume of 5 mL, washed with 25 mL of water and equilibrated with 25 mL of loading buffer. The filtered cell extract is loaded onto the column at 0.5 mL per minute. The column is washed to baseline $A_{280}$ with loading buffer, at which point fraction collection is started. Next, the column is washed with a secondary wash buffer (50 mM phosphate; 300 mM NaCl, 10% Glycerol, pH 6.0), which elutes nonspecifically bound protein. After reaching $A_{280}$ baseline again, the column is developed with a 0 to 500 mM Imidazole gradient in the secondary wash buffer. One mL fractions are collected and analyzed by SDS-PAGE and silver staining or western blot with $Ni^{2+}$-NTA-conjugated to alkaline phosphatase (Qiagen). Fractions containing the eluted $His_{10}$-tagged sequence are pooled and dialyzed against loading buffer.

Alternatively, purification of the IgG tagged (or Fc tagged) amino acid sequence can be performed using known chromatography techniques, including for instance, Protein A or Protein G column chromatography.

Immunoadhesin (Fc containing) constructs of proteins can be purified from conditioned media as follows. The conditioned media is pumped onto a 5 ml Protein A column (Pharmacia) which is equilibrated in 20 mM Na phosphate buffer, pH 6.8. After loading, the column is washed extensively with equilibration buffer before elution with 100 mM citric acid, pH 3.5. The eluted protein is immediately neutralized by collecting 1 ml fractions into tubes containing 275 mL of 1 M Tris buffer, pH 9. The highly purified protein is subsequently desalted into storage buffer as described above for the poly-His tagged proteins. The homogeneity of the proteins is verified by SDS polyacrylamide gel (PEG) electrophoresis and N-terminal amino acid sequencing by Edman degradation.

Intein-Based C-Terminal Syntheses

As described, for example, in U.S. Pat. No. 6,849,428, issued Feb. 1, 2005, inteins are the protein equivalent of the self-splicing RNA introns (see Perler et al., Nucleic Acids Res. 22:1125-1127 (1994)), which catalyze their own excision from a precursor protein with the concomitant fusion of the flanking protein sequences, known as exteins (reviewed in Perler et al., Curr. Opin. Chem. Biol. 1:292-299 (1997); Perler, F. B. Cell 92(1):1-4 (1998); Xu et al., EMBO J. 15(19):5146-5153 (1996)).

Studies into the mechanism of intein splicing led to the development of a protein purification system that utilized thiol-induced cleavage of the peptide bond at the N-terminus of the Sce VMA intein (Chong et al., Gene 192(2):271-281 (1997)). Purification with this intein-mediated system generates a bacterially-expressed protein with a C-terminal thioester (Chong et al., (1997)). In one application, where it is described to isolate a cytotoxic protein, the bacterially expressed protein with the C-terminal thioester is then fused to a chemically-synthesized peptide with an N-terminal cysteine using the chemistry described for "native chemical ligation" (Evans et al., Protein Sci. 7:2256-2264 (1998); Muir et al., Proc. Natl. Acad. Sci. USA 95:6705-6710 (1998)).

This technique, referred to as "intein-mediated protein ligation" (IPL), represents an important advance in protein semi-synthetic techniques. However, because chemically-synthesized peptides of larger than about 100 residues are difficult to obtain, the general application of IPL was limited by the requirement of a chemically-synthesized peptide as a ligation partner.

IPL technology was significantly expanded when an expressed protein with a predetermined N-terminus, such as cysteine, was generated, as described for example in U.S. Pat. No. 6,849,428. This allows the fusion of one or more expressed proteins from a host cell, such as bacterial, yeast or mammalian cells. In one non-limiting example the intein a modified RIR1 *Methanobacterium thermoautotrophicum* is that cleaves at either the C-terminus or N-terminus is used which allows for the release of a bacterially expressed protein during a one-column purification, thus eliminating the need proteases entirely.

Intein technology is one example of one route to obtain components. In one embodiment, the subunits of the compounds of the invention are obtained by transfecting suitable cells, capable of expressing and secreting mature chimeric polypeptides, wherein such polypeptides comprise, for example, an adhesin domain contiguous with an isolatable c-terminal intein domain (see U.S. Pat. No. 6,849,428, Evans et al., issued Feb. 1, 2005, hereby incorporated by reference). The cells, such as mammalian cells or bacterial cells, are transfected using known recombinant DNA techniques. The secreted chimeric polypeptide can then be isolated, e.g. using a chitin-derivatized resin in the case of an intein-chitin binding domain (see U.S. Pat. No. 6,897,285, Xu et al., issued May 24, 2005, hereby incorporated by reference), and is then treated under conditions permitting thiol-mediated cleavage and release of the now C-terminal thioester-terminated adhesion subunit. The thioester-terminated adhesion subunit is readily converted to a C-terminal cysteine terminated subunit.

These subunits can be treated under oxidizing conditions to permit formation of, for example, a disulfide bond between the two terminal cysteine residues, thus forming a symmetroadhesin. In addition, this technique can be used to make the symmetroadhesin-Fc hybrid subunits by treating the individual adhesion-Fc heterodimers under conditions permitting formation of bonds between the Fc portions of the heterodimers.

Example 1

Preparation of Immunoglobulin Fc with N-Terminal-S-Termini (S-Fc)

Digestion of immunoglobulin (IgG) with papain yields two Fab fragments and one Fc fragment (Porter (1959) Biochem. 73, 119-126). The site of proteolysis in human IgG is the heavy chain hinge region between the cys-5 and cys-11 residues, EPKSCDKTHTCPPCP, (Fleischman et al., Biochem J. (1963) 88, 220-227; Edelman et al. (1969) Proc. Natl. Acad. Sci. 63, 78-85). The cys-5 residue normally forms a disulfide bond with the human IgG light chain, which is easily cleaved under mild reducing conditions, making it an ideal candidate for Fc-like molecules with N-terminal-S-termini (S-Fc).

Accordingly, host cells were transfected with expression vectors encoding IgG1 pre-Fc chimeric polypeptides consisting of a signal peptide joined at its C-terminus by a peptide bond to the N-terminus of an Fc domain beginning at the cys-5 residue, CDKTHTCPPCP (FIG. 35A). The heterologous signal peptides used are selected from proteins with N-terminal cysteines (part i). Thus, cleavage by the cellular signal peptidase will provide a mature S-Fc protein having cys-5 at the N-terminus (part ii).

The sequences of the IgG1 precursor polypeptides of FIG. 35A are shown in SEQ ID NO: 32, SEQ ID NO:33, and SEQ ID NO:34. The sequence of the mature IgG1 polypeptide of FIG. 35A is shown in SEQ ID NO: 35. Other mature IgG1 polypeptides made by methods described in EXAMPLES 1 to 5 are shown in SEQ ID NO: 36 through SEQ ID NO: 46.

Host cells are transfected with expression vectors encoding IgG2 pre-Fc chimeric polypeptides consisting of a signal peptide joined at its C-terminus by a peptide bond to the N-terminus of an Fc domain beginning at the cys-4 residue, CCVECPPCP (FIG. 35B). The heterologous signal peptides used are selected from proteins with N-terminal cysteines (part i). Thus, cleavage by the cellular signal peptidase will provide a mature S-Fc protein having cys-4 at the N-terminus (part).

The sequences of the IgG2 precursor polypeptides of FIG. 35B are shown in SEQ ID NO:50, SEQ ID NO:51, and SEQ ID NO:52. The sequence of the mature IgG2 polypeptide of FIG. 35B is shown in SEQ ID NO:53. Other mature IgG2 polypeptides made by methods described in EXAMPLES 1 to 5 are shown in SEQ ID NO:54 through SEQ ID NO:67.

Host cells are transfected with expression vectors encoding IgG3 pre-Fc chimeric polypeptides consisting of a signal peptide joined at its C-terminus by a peptide bond to the N-terminus of an Fc domain beginning at the cys-13 residue, CPRCP (FIG. 35C). The heterologous signal peptides used are selected from proteins with N-terminal cysteines (part i). Thus, cleavage by the cellular signal peptidase will provide a mature S-Fc protein having cys-13 at the N-terminus (part ii).

The sequences of the IgG3 precursor polypeptides of FIG. 35C are shown in SEQ ID NO:71, SEQ ID NO:72, and SEQ ID NO:73. The sequence of the mature IgG3 polypeptide of FIG. 35C is shown in SEQ ID NO:74. Other mature IgG2 polypeptides made by methods described in EXAMPLES 1 to 5 are shown in SEQ ID NO:75 through SEQ ID NO:82.

Host cells are transfected with expression vectors encoding IgG4 pre-Fc chimeric polypeptides consisting of a signal peptide joined at its C-terminus by a peptide bond to the N-terminus of an Fc domain beginning at the cys-8 residue, CPSCP (FIG. 35D). The heterologous signal peptides used are selected from proteins with N-terminal cysteines (part i). Thus, cleavage by the cellular signal peptidase will provide a mature S-Fc protein having cys-8 at the N-terminus (part ii).

The sequences of the IgG4 precursor polypeptides of FIG. 35D are shown in SEQ ID NO:86, SEQ ID NO:87, and SEQ ID NO:88. The sequence of the mature IgG4 polypeptide of FIG. 35D is shown in SEQ ID NO:89. Other mature IgG4 polypeptides made by methods described in EXAMPLES 1 to 5 are shown in SEQ ID NO:90 through SEQ ID NO:97.

Suitable host cells include 293 human embryonic cells (ATCC CRL-1573) and CHO-K1 hamster ovary cells (ATCC CCL-61) obtained from the American Type Culture Collection (Rockville, Md.). Cells are grown at 37° C. in an atmosphere of air, 95%; carbon dioxide, 5%. 293 cells are maintained in Minimal essential medium (Eagle) with 2 mM L-glutamine and Earle's BSS adjusted to contain 1.5 g/L sodium bicarbonate, 0.1 mM non-essential amino acids, and 1.0 mM sodium pyruvate, 90%; fetal bovine serum, 10%. CHO-K1 cells are maintained in Ham's F12K medium with 2 mM L-glutamine adjusted to contain 1.5 g/L sodium bicarbonate, 90%; fetal bovine serum, 10%. Other suitable host cells include CV1 monkey kidney cells (ATCC CCL-70), COS-7 monkey kidney cells (ATCC CRL-1651), VERO-76 monkey kidney cells (ATCC CRL-1587), HELA human cervical cells (ATCC CCL-2), W138 human lung cells (ATCC CCL-75), MDCK canine kidney cells (ATCC CCL-34), BRL3A rat liver cells (ATCC CRL-1442), BHK hamster kidney cells (ATCC CCL-10), MMT060562 mouse mammary cells (ATCC CCL-51), and human $CD8^+$ T lymphocytes (described in U.S. Ser. No. 08/258,152 incorporated herein in its entirety by reference).

An example of a suitable expression vector is plasmid pSA (SEQ ID NO:1). Plasmid pSA contains the following DNA sequence elements: 1) pBluescriptIIKS(+) (nucleotides 912 to 2941/1 to 619, GenBank Accession No. X52327), 2) a human cytomegalovirus promoter, enhancer, and first exon splice donor (nucleotides 63 to 912, GenBank Accession No. K03104), 3) a human alpha1-globin second exon splice acceptor (nucleotides 6808 to 6919, GenBank Accession No. J00153), 4) an SV40 T antigen polyadenylation site (nucleotides 2770 to 2533, Reddy et al. (1978) Science 200, 494-502), and 5) an SV40 origin of replication (nucleotides 5725 to 5578, Reddy et al., ibid). For expression of the polypeptide of interest, an EcoRI-BglII DNA fragment encoding the polypeptide is inserted into plasmid pSA between the EcoRI and BglII restriction sites located at positions 1,608 and 1,632, respectively. Other suitable expression vectors include plasmids pSVeCD4DHFR and pRKCD4 (U.S. Pat. No. 5,336,603), plasmid pIK.1.1 (U.S. Pat. No. 5,359,046), plasmid pVL-2 (U.S. Pat. No. 5,838,464), plasmid pRT43.2F3 (described in U.S. Ser. No. 08/258,152 incorporated herein in its entirety by reference), and plasmid pCDNA3.1(+) (Invitrogen, Inc.).

Suitable selectable markers include the Tn5 transposon neomycin phosphotransferase (NEO) gene (Southern and Berg (1982) J. Mol. Appl. Gen. 1, 327-341), and the dihydrofolate reductase (DHFR) cDNA (Lucas at al. (1996) Nucl. Acids Res. 24, 1774-1779). One example of a suitable expression vector that incorporates a NEO gene is plasmid pSA-NEO, which is constructed by ligating a first DNA fragment, prepared by digesting SEQ ID NO:2 with EcoRI and BglII, with a second DNA fragment, prepared by digesting SEQ ID NO:1 with EcoRI and BglII. SEQ ID NO:2 incorporates a NEO gene (nucleotides 1551 to 2345, Genbank Accession No. U00004) preceded by a sequence for translational initiation (Kozak (1991) J. Biol. Chem, 266, 19867-19870). Another example of a suitable expression vector that incorporates a NEO gene and a DHFR cDNA is plasmid pSVe-NEO-DHFR, which is constructed by ligating a first DNA fragment, prepared by digesting SEQ ID NO:2 with EcoRI and BglII, with a second DNA fragment, prepared by digesting pSVeCD4DHFR with EcoRI and BglII. Plasmid pSVe-NEO-DHFR uses SV40 early promoter/enhancers to drive expression of the NEO gene and the DHFR cDNA. Other suitable selectable markers include the XPGT gene (Mulligan and Berg (1980) Science 209, 1422-1427) and the hygromycin resistance gene (Sugden et al. (1985) Mol. Cell. Biol. 5, 410-413).

Human IgG1 DNA sequences are described in Ellison et al. (1982) Nuc. Acids Res. 10, 4071-4079) (Genbank Acc. No. Z17370).

Suitable examples of signal peptides are sonic hedgehog (SHH) (GenBank Acc. No. NM_000193), interferonα-2 (IFN) (GenBank Acc. No. NP_000596), and cholesterol ester transferase (CETP) (GenBank Accession No. NM_000078).

Other suitable examples include Indian hedgehog (Genbank Acc. No. NM_002181), desert hedgehog (Genbank Acc. No. NM_021044), IFNα-1 (Genbank Acc. No. NP_076918), IFNα-4 (Genbank Acc. No. NM_021068), IFNα-5 (Genbank Acc. No. NM_002169), IFNα-6 (Genbank Acc. No. NM_021002), IFNα-7 (Genbank Acc. No. NM_021057), IFNα-8 (Genbank Acc. No. NM_002170), IFNα-10 (Genbank Acc. No. NM_002171), IFNα-13 (Genbank Acc. No. NM_006900), IFNα-14 (Genbank Acc. No. NM_002172), IFNα-16 (Genbank Acc. No. NM_002173), IFNα-17 (Genbank Acc. No. NM_021268) and IFNα-21 (Genbank Acc. No. NM_002175).

Suitable expression vectors are constructed by ligation of an insert and vector fragment prepared by digestion with EcoRI and BglII. For unamplified expression, plasmid pSHH-Fc5 (SHH signal) is constructed using SEQ ID NO:3 and SEQ ID NO:1, plasmid pIFN-Fc5 (IFN signal) is constructed using SEQ ID NO:4 and SEQ ID NO:1 and plasmid pCETP-Fc5 (CETP signal) is constructed using SEQ ID NO:3 and SEQ ID NO:1. For amplified expression, plasmid pSHH-Fc5-DHFR is constructed using SEQ ID NO:3 and pSVeCD4DHFR (U.S. Pat. No. 5,336,603), pIFN-Fc5-DHFR is constructed using SEQ ID NO:4 and pSVeCD4DHFR, and pCETP-Fc5-DHFR is constructed using SEQ ID NO:5 and pSVeCD4DHFR.

Suitable expression vectors for human IgG1 Fc polypeptides were constructed by ligation of an insert fragment prepared by digestion with Hind III and EagI and a vector fragment prepared by digestion with Hind III and PspOM1. Plasmid pCDNA3-SHH-IgG1-Fc (SHH signal) was constructed using SEQ ID NO:29 and pCDNA3.1(+), plasmid pCDNA3-IFN-IgG1-Fc (IFN signal) was constructed using SEQ ID NO:30 and pCDNA3.1(+), and plasmid pCDNA3-IgG1-Fc (CETP signal) was constructed using SEQ ID NO:31 and pCDNA3.1(+).

Suitable expression vectors for human IgG2 Fc polypeptides are constructed by ligation of an insert fragment prepared by digestion with Hind III and EagI and a vector fragment prepared by digestion with Hind III and PspOM1. Plasmid pCDNA3-SHH-IgG2-Fc (SHH signal) is constructed using SEQ ID NO:47 and pCDNA3.1(+), plasmid pCDNA3-IFN-IgG2-Fc (IFN signal) is constructed using SEQ ID NO:48 and pCDNA3.1(+), and plasmid pCDNA3-IgG2-Fc (CETP signal) is constructed using SEQ ID NO:49 and pCDNA3.1(+).

Suitable expression vectors for human IgG3 Fc polypeptides are constructed by ligation of an insert fragment prepared by digestion with Hind III and EagI and a vector fragment prepared by digestion with Hind III and PspOM1. Plasmid pCDNA3-SHH-IgG3-Fc (SHH signal) is constructed using SEQ ID NO:68 and pCDNA3.1(+), plasmid pCDNA3-IFN-IgG3-Fc (IFN signal) is constructed using SEQ ID NO:69 and pCDNA3.1(+), and plasmid pCDNA3-IgG3-Fc (CETP signal) is constructed using SEQ ID NO:70 and pCDNA3.1(+).

Suitable expression vectors for human IgG4 Fc polypeptides are constructed by ligation of an insert fragment prepared by digestion with Hind III and EagI and a vector fragment prepared by digestion with Hind III and PspOM1. Plasmid pCDNA3-SHH-IgG4-Fc (SHH signal) is constructed using SEQ ID NO:83 and pCDNA3.1(+), plasmid pCDNA3-IFN-IgG4-Fc (IFN signal) is constructed using SEQ ID NO:84 and pCDNA3.1(+), and plasmid pCDNA3-IgG4-Fc (CETP signal) is constructed using SEQ ID NO:85 and pCDNA3.1(+).

In one embodiment, cells are transfected by the calcium phosphate method of Graham et al. (1977) J. Gen. Virol. 36, 59-74. A DNA mixture (10 micrograms) is dissolved in 0.5 ml of 1 mM Tris-HCl, 0.1 mM EDTA, and 227 mM $CaCl_2$. The DNA mixture contains (in a ratio of 10:1:1) the expression vector DNA, the selectable marker DNA, and a DNA encoding the VA RNA gene (Thimmappaya et al. (1982) Cell 31, 543-551). To this mixture is added, dropwise, 0.5 mL of 50 mM Hepes (pH 7.35), 280 mM NaCl, and 1.5 mM $NaPO_4$. The DNA precipitate is allowed to form for 10 minutes at 25° C., then suspended and added to cells grown to confluence on 100 mm plastic tissue culture dishes. After 4 hours at 37° C., the culture medium is aspirated and ml of 20% glycerol in PBS is added for 0.5 minutes. The cells are then washed with serum-free medium, fresh culture medium is added, and the cells are incubated for 5 days.

In another embodiment, cells are transiently transfected by the dextran sulfate method of Somparyrac et al. (1981) Proc. Nat. Acad. Sci. 12, 7575-7579. Cells are grown to maximal density in spinner flasks, concentrated by centrifugation, and washed with PBS. The DNA-dextran precipitate is incubated on the cell pellet. After 4 hours at 37° C., the DEAE-dextran is aspirated and 20% glycerol in PBS is added for 1.5 minutes. The cells are then washed with serum-free medium, and re-introduced into spinner flasks containing fresh culture medium with micrograms/ml bovine insulin and 0.1 micrograms/ml bovine transferring, and the cells are incubated for 4 days. Following transfection by either method, the conditioned media is centrifuged and filtered to remove the host cells and debris. The sample contained the S-Fc domain is then concentrated and purified by any selected method, such as dialysis and/or column chromatography (see below).

To identify the S-Fc in the cell culture supernatant, the culture medium is removed 24 hours after transfection and replaced with culture medium containing 200 microCi/ml each of $^{35}$S-methionine and $^{35}$S-cysteine. After a 12 hour incubation, the conditioned medium is collected by centrifugation to remove the host cells and debris, concentrated on a spin dialysis filter. The labeled supernatants is analyzed by immunoprecipitation with protein A sepharose beads in the absence of added antibodies. The precipitated proteins are analyzed on 7.5% polyacrylamide-SDS gels either with or without reduction with β-mercaptoethanol. The processed gel is dried and exposed to x-ray film to reveal the presence of the S-Fc domain.

For unamplified expression, plasmids pSHH-Fc-5, pIFN-Fc-5 and pCETP-Fc-5 are transfected into human 293 cells (Graham et al., J. Gen. Virol. 36:59 74 (1977)), using a high efficiency procedure (Gorman et al., DNA Prot. Eng. Tech. 2:3 10 (1990)). Media is changed to serum-free and harvested daily for up to five days. The S-Fc proteins are purified from the cell culture supernatant using protein A-Sepharose CL-4B (Pharmacia). The eluted S-Fc protein is buffer-exchanged into PBS using a Centricon-30 (Amicon), concentrated to 0.5 ml, sterile filtered using a Millex-GV (Millipore) and stored at 4° C.

For unamplified expression, plasmids pCDNA3-SHH-IgG1-Fc, pCDA3-IFN-IgG1-Fc and pCDA-3-CETP-IgG1-Fc were transfected into human 293 cells (Graham et al., J. Gen. Virol. 36:59 74 (1977)), using a high efficiency procedure (Gorman et al., DNA Prot. Eng. Tech. 2:3 10 (1990)). Media was changed to serum-free and harvested daily for up to five days. The S-Fc proteins were purified from the cell culture supernatant using protein A-Sepharose CL-4B (Pharmacia). The eluted S-Fc protein was buffer-exchanged into PBS using a Centricon-30 (Amicon), concentrated to 0.5 ml, sterile filtered using a Millex-GV (Millipore) and stored at 4° C.

FIG. 52 shows expression in 293 kidney cells of human IgG1 Fc symmetroadhesin subunits with N-terminal-S-termini. Lanes 1-6 and lanes 7-12 show the IgG1 Fc polypeptides of FIG. 35A (ii) and FIG. 36A (ii), respectively. Cell supernatants: lanes 1, 3, 5, 7, 9 and 11; cell lysates: lanes 2, 4, 6, 8, 10 and 12. Signal sequences used: SHH (lanes 1, 2, 7 and 8); IFNA (lanes 3, 4, 9, 10); CETP (lanes 5, 6, 11 and 12).

FIG. 53 shows expression in 293 kidney cells of human IgG1 Fc symmetroadhesin subunits. Lanes 1-2, 3-4 and 5-6 show the IgG1 Fc polypeptides of FIG. 35A (ii), FIG. 36A (ii) and FIG. 37B (ii), respectively. Cell supernatants: (lanes 1-6). Signal sequences used: SHH (lanes 1-6).

FIG. 54 shows Protein A purification of human IgG1 Fc symmetroadhesin subunits expressed in 293 kidney cells. Lane 2 and 8 show the IgG1 Fc polypeptides of FIG. 36A and FIG. 35A, respectively. Lanes 1-7: proteinA-sepharose column fractions for the IgG1 Fc polypeptide of FIG. 36A.

FIG. 55 shows Thiol-sepharose binding of proteinA-purified human IgG1 Fc symmetroadhesin subunits shown in FIG. 54. Lanes 1-3 and lanes 4-6 show the human IgG1 Fc polypeptides of FIG. 35A and FIG. 36A, respectively. Lanes 1 and 4: starting material; lanes 2 and 5: thiol-sepharose flow-thru fraction; lanes 3 and 6: thiol-sepharose bound fraction.

Analysis of the two IgG1 Fc polypeptides of FIG. 35A and FIG. 36A by mass spectrometry (MALDI) reveals average molecular masses of 54,552.85 and 53,173.43 daltons, respectively. Assuming each molecular mass represents the corresponding Fc dimers, the apparent difference in molecular mass between the two polypeptides (1,379.4 daltons) is in good agreement (0.6% deviation) with the predicted difference in molecular mass (1,371.5).

For amplified expression, Chinese hamster ovary (CHO) cells are transfected with dicistronic vectors pSHH-Fc5-

DHFR, pIFN-Fc-5-DHFR and pCETP-Fc-5-DHFR which co-express a DHFR cDNA. Plasmids are introduced into CHO-K1 DUX B11 cells developed by L. Chasin (Columbia University) via lipofection and selected for growth in GHT-free medium (Chisholm (1996) High efficiency gene transfer in mammalian cells. In: Glover, D M, Hames, B D. DNA Cloning vol 4. Mammalian systems. Oxford Univ. Press, pp 1-41). Approximately 20 unamplified clones are randomly chosen and reseeded into 96 well plates. Relative specific productivity of each colony is monitored using an ELISA to quantitate the S-Fc protein accumulated in each well after 3 days and a fluorescent dye, Calcien AM, as a surrogate marker of viable cell number per well. Based on these data, several unamplified clones are chosen for further amplification in the presence of increasing concentrations of methotrexate. Individual clones surviving at 10, 50, and 100 nM methotrexate are chosen and transferred to 96 well plates for productivity screening. Suitable clones, which reproducibly exhibit high specific productivity, are expanded in T-flasks and used to inoculate spinner cultures. After several passages, the suspension-adapted cells are used to inoculate production cultures in GHT-containing, serum-free media supplemented with various hormones and protein hydrolysates. Harvested cell culture fluid containing the S-Fc protein is purified using protein A-Sepharose CL-4B.

Example 2

Preparation of Immunoglobulin Fc with N-Terminal-X-Termini (X-Fc)

Selenocysteine (sec) is the $21^{st}$ amino acid incorporated during ribosome-mediated protein synthesis (Zinoni et al. (1986) Proc. Natl Acad. Sci. 83, 4650-4654; Chambers et al. (1986) EMBO J. 5, 1221-1227). The process is complex and distinct from cysteine incorporation, requiring an mRNA selenocysteine insertion element in order to decode a UGA stop codon. Protein semi-synthesis offers an alternative means for preparing Fc-like molecules having N-terminal-X-termini (X-Fc) that begin at cysteine (cys) and/or selenocysteine (sec).

Accordingly, host cells are transfected with constructs that encode pre-Fc chimeric polypeptides consisting of a signal peptide joined at its C-terminus by a peptide bond to the N-terminus of an Fc domain beginning at cys-11, CDK-THTCPPCP (FIG. 36A) and cys-14 CDKTHTCPPCP (FIG. 36B). The heterologous signal peptides used are selected from proteins with N-terminal cysteines (part i). Thus, cleavage by the cellular signal peptidase will provide a mature S-Fc protein having cys-11 at the N-terminus (part ii). Native chemical ligation is then employed to prepare mature X-Fc proteins having cys-5 or sec-5 at the N-terminus, XDKTHTCPPCP (part iii).

The sequences of the IgG1 precursor polypeptides of FIG. 36A are shown in SEQ ID NO: 101, SEQ ID NO:102, and SEQ ID NO:103. The sequence of the mature IgG1 polypeptide of FIG. 35A is shown in SEQ ID NO: 104. The sequences of the IgG1 precursor polypeptides of FIG. 36B are shown in SEQ ID NO: 109, SEQ ID NO:110, and SEQ ID NO:111. The sequence of the mature IgG1 polypeptide of FIG. 35B is shown in SEQ ID NO: 112.

Accordingly, host cells are transfected with constructs that encode pre-Fc chimeric polypeptides consisting of a signal peptide joined at its C-terminus by a peptide bond to the N-terminus of an Fc domain beginning at cys-14, CDK-THTCPPCP (FIG. 36B). The heterologous signal peptides used are selected from proteins with N-terminal cysteines (part i). Thus, cleavage by the cellular signal peptidase will provide a mature S-Fc protein having cys-11 at the N-terminus (part ii). Native chemical ligation is then employed to prepare mature X-Fc proteins having cys-11 or sec-11 at the N-terminus, XPPCP (part iii).

The S-Fc proteins with cys-11 and cys-14 at the N-terminus is first prepared using the procedures described in EXAMPLE 1. Native chemical ligation is carried out with S-Fc protein and peptide Fc-A (5-11: cys-asp-lys-thr-his-thr), or S-Fc protein and peptide Fc-B (5-11: sec-asp-lys-thr-his-thr). Suitable expression vectors are constructed by ligation of an insert and vector fragment prepared by digestion with EcoRI and BglII. For unamplified expression, plasmid pSHH-Fc11 (SHH signal) is constructed using SEQ ID NO:6 and SEQ ID NO:1, plasmid pIFN-Fc11 (IFN signal) is constructed using SEQ ID NO 7 and SEQ ID NO:1 and plasmid pCETP-Fc11 (CETP signal) is constructed using SEQ ID NO:8 and SEQ ID NO:1. For amplified expression, plasmid pSHH-Fc11-DHFR is constructed using SEQ ID NO:6 and pSVeCD4DHFR, plasmid pIFN-Fc11-DHFR is constructed using SEQ ID NO:7 and pSVeCD4DHFR, and plasmid pCETP-Fc11-DHFR is constructed using SEQ ID NO:8 and pSVeCD4DHFR.

Suitable expression vectors for human IgG1 Fc are constructed by ligation of an insert fragment prepared by digestion with Hind III and EagI and a vector fragment prepared by digestion with Hind III and PspOM1. Plasmid pCDNA3-SHH-IgG1-Fc11 (SHH signal) is constructed using SEQ ID NO:98 and pCDNA3.1(+), plasmid pCDNA3-IFN-IgG1-Fc11 (IFN signal) is constructed using SEQ ID NO:99 and pCDNA3.1(+), and plasmid pCDNA3-IgG1-Fc11 (CETP signal) is constructed using SEQ ID NO:100 and pCDNA3.1(+). Plasmid pCDNA3-SHH-IgG1-Fc14 (SHH signal) is constructed using SEQ ID NO:106 and pCDNA3.1(+), plasmid pCDNA3-IFN-IgG1-Fc14 (IFN signal) is constructed using SEQ ID NO:107 and pCDNA3.1 (+), and plasmid pCDNA3-IgG1-Fc14 (CETP signal) is constructed using SEQ ID NO:108 and pCDNA3.1(+).

General principles of native chemical ligation are described in U.S. Pat. No. 6,184,344, the whole of which is incorporated herein by reference. Peptides Fc-A and Fc-B are synthesized using a TAMPAL resin from which any desired thioester can be readily obtained. After de-protection of side chain protecting groups, the resulting C-terminal activated peptides are used in native chemical ligation without further modification. To prevent the cyclization or polymerization of bifunctional peptides, the sulfhydryl moiety (peptide Fc-A) and the selenohydryl moiety (peptide Fc-B) are reversibly blocked with Msc.

Peptide synthesis is carried out by manual a solid-phase procedure using an in situ neutralization/HBTU activation procedure for Boc chemistry (Schnolzer et al. (1992) Int. J. Pept. Protein Res. 40, 180-193). After each coupling step, yields are determined by measuring residual free amine with the quantitative ninhydrin assay (Sarin et al. (1981) Anal. Biochem. 117, 147-157). Side chain protected amino acids are Boc-Asp(O-cyclohexyl)-OH, Boc-Cys(4-methylbenzyl)-OH, Boc-Lys(2-Cl—Z)—OH, and Boc-Thr(benzyl)-OH. After chain assembly is completed, peptides are deprotected and cleaved from the resin by treatment with anhydrous HF for 1 hour at 0° C. with 4% anisole as scavenger.

Peptides Fc-A and Fc-B are synthesized on trityl-associated mercaptopropionic acid leucine (TAMPAL) resin to yield C-terminal MPAL-activated thioesters (Hackeng et al. (1999) Proc. Natl. Acad. Sci. 96, 10068-10073). The N-terminal cys/sec residues of the thioester peptides are protected with 2-(methylsulfonyl)ethyl carbonate (Msc) groups in a 2 hour reaction (10-fold excess) of activated Msc nitrophenol ester dissolved in a minimal volume of dimethylformamide/5% diisopropylethylamine. The thioester-activated peptides are deprotected and cleaved from the TAMPAL resin, HPLC-purified, lyophilized, and stored until use at −20° C. Preparative reversed-phase HPLC is performed using a Vydac C-18 column (10 micrometer, 1.0 cm×25 cm). The bound peptides are eluted using a linear gradient of acetonitrile in H$_2$O/10% trifluoroacetic acid.

Starting with the purified C-terminal S-Fc protein, native chemical ligation is carried out with the Msc-NH-cys$^5$-thr$^{10}$-α-thioester peptide (Fc-A) or the Msc-NH-sec$^5$-thr$^{10}$-α-thioester peptide (Fc-B) under non-denaturing conditions as previously described (Evans et al. (1999) J. Biol. Chem. 274, 3923-3926). The thioester-activated peptides are mixed in molar excess with freshly prepared S-Fc protein (starting concentration, 1-200 micromolar). The solution is concentrated with a Centriprep 3/30 apparatus (Millipore, MA), then with a Centricon 3/10 apparatus to a final concentration of 0.15 to 1.2 mM for the S-Fc protein. Ligations are incubated overnight at 4° C. and visualized using SDS-page electrophoresis. After native chemical ligation, the N-terminal Msc protecting group is removed by a brief incubation (<5 minute) at pH 13. The X-Fc product is purified to remove unreacted peptides by affinity chromatography with protein A sepharose using the procedure in EXAMPLE 1.

The sequence of the native ligation product of FIG. 36A is shown in SEQ ID NO: 105. The sequence of the native ligation product of FIG. 36B is shown in SEQ ID NO: 113.

Example 3

Preparation of Immunoglobulin Fc with C-Terminal-X-Termini (Fc-X)

IgG is expressed in two abundant forms, the soluble antibody molecule and the cell-bound B-cell receptor.

Both forms arise from a single messenger RNA by alternative splicing with the result that two additional exons are added to the IgG heavy chain coding region (Tyler et al. (1982) Proc. Natl. Acad. Sci. 79, 2008-2012; Yamawaki-Kataoka et al. (1982) Proc. Natl. Acad. Sci. 79, 2623-2627). The first exon added (M1 exon) encodes a stretch of 18 amino acids, ELQLEESCAEAQDGELDG, which flexibly tethers IgG to the cell surface, making it a good choice for novel Fc-like molecules with a C-terminal-X-terminus (Fc-X). The C-terminal gly-18 residue of the M1 domain is also well-suited for preparing Fc-intein fusion proteins used in generating a C-terminal activated thioester. Following an intein autocleavage reaction, a thioester intermediate is generated that permits the facile addition of cysteine or selenocysteine to the C-terminus by native chemical ligation.

Accordingly, host cells are transfected with expression vectors that encode pre-Fc-intein chimeric polypeptides containing the M1 domain joined at its C-terminus, ELQLEESCAEAQDGELDG, by a peptide bond to the N-terminus of a self-splicing intein at the autocleavage site (FIG. 37A), or the Fc protein containing a portion of the M1 domain, ELQLEESC (FIG. 37B). To ensure that the Fc-X protein does not have an N-terminal-X-terminus, heterologous signal peptides are used that are cleaved by the cellular signal peptidase before lysine residues (part i). Thus, cleavage by the cellular signal peptidase will provide a Fc-intein fusion protein with lys-7, EPKSCDKTHTCPPCP, at the N-terminus (part ii). Excision of the intein domain by protein splicing provides an Fc-thioester intermediate (part iii). Finally, native chemical ligation of the Fc-thioester with free cysteine and/or selenocysteine is employed to prepare Fc-X proteins having the C-terminal-X-terminus, ELQLEESCAEAQDGELDGX (part iv).

The sequences of the IgG1 precursor polypeptides of FIG. 37A are shown in SEQ ID NO:116, and SEQ ID NO:117. The sequence of the mature and modified IgG1 polypeptides of FIG. 37A is shown in SEQ ID NO:118 to SEQ ID NO:120. The sequences of the IgG1 precursor polypeptides of FIG. 37B are shown in SEQ ID NO:123, and SEQ ID NO:124. The sequence of the mature IgG1 polypeptide of FIG. 37B is shown in SEQ ID NO:125.

The Fc-intein fusion protein with lys-7 at the N-terminus is prepared using the procedures described in EXAMPLE 1. The initial purification step is carried out using affinity chromatography with a chitin resin instead of protein A sepharose. After cleavage from the resin, the activated Fc-thioester intermediate is used directly for native ligation with cysteine and/or selenocysteine.

A suitable DNA sequence for the M1 membrane domain of human IgG1 is described in Strausberg et. al. (2002) Proc. Natl. Acad. Sci. 99, 16899-16903 (GenBank Acc. No. BC019046).

Suitable examples of signal peptides are the CD2 T-cell surface glycoprotein (CD2) (GenBank Acc. No. NM_001767), and the CD4 T-cell surface glycoprotein (CD4) (GenBank Acc. No. NP_000616).

A suitable example of a self-splicing intein is found in the *Methanobacterium thermoautotrophicum* ribonucleotide reductase large subunit (MthRIR1) (Genbank Acc. No. AE000845). To limit the intein autocleave reaction to the Fc-intein fusion junction, an MthRR1 intein variant with only N-terminal cleavage activity is prepared by changing the pro at position −1 to gly and the C-terminal asn at position 134 to ala (Evans et al. (1999) J. Biol. Chem. 274, 3923-3926). In addition, an Mth RRI intein sequence fused to a *Bacillus circulans* chitin binding domain is used to facilitate the purification of the Fc-intein chimeric polypeptide by affinity chromatography. A suitable sequence for the modified MthRIR1 intein is found in plasmid pTWIN-2 (New England BioLabs, MA).

Other suitable examples are found in the *Mycobacterium xenopi* gyrase subunit A (Mxe GyrA) (Genbank Acc. No. MXU87876), and the *Saccharomyces cerevisiae* vacuolar ATPase (Sce VMA1) (GenBank Acc. No. NC_001136). Many other suitable examples of self-splicing inteins are described in *Inbase: the Intein Database* (Perler (2002) Nucl. Acids Res. 30, 383-384).

Suitable expression vectors are constructed by ligation of an insert and vector fragment prepared by digestion with EcoRI and BglII. For unamplified expression, plasmid pCD2-Fc7-Mth (CD2 signal) is constructed with SEQ ID NO:9 and SEQ ID NO:1, and plasmid pCD4-Fc7-Mth (CD4 signal) is constructed with SEQ ID NO:10 and SEQ ID NO:1. For amplified expression, plasmid pCD2-Fc7-Mth-DHFR is constructed with SEQ ID NO:9 and pSVeCD4DHFR, and plasmid pCD4-Fc7-Mth-DHFR is constructed with SEQ ID NO:10 and pSVeCD4DHFR.

Suitable expression vectors are constructed by ligation of an insert fragment prepared by digestion with Hind III and EagI and a vector fragment prepared by digestion with Hind III and PspOM1. Plasmid pCDNA3-CD2-Fc7-Mth (CD2 signal) is constructed with SEQ ID NO:114 and pCDNA3.1 (+), and plasmid pCDNA3-CD4-Fc7-Mth (CD4 signal) is constructed with SEQ ID NO:115 and pCDNA3.1(+). Plasmid pCDNA3-CD2-Fc7-ELQLEESC (CD2 signal) is constructed with SEQ ID NO:121 and pCDNA3.1(+), and plasmid pCDNA3-CD4-Fc7-ELQLEESC (CD4 signal) is constructed with SEQ ID NO:122 and pCDNA3.1(+).

General principles of chitin affinity purification and the self-splicing intein autocleavage reaction are described in U.S. Pat. No. 5,834,247, the whole of which is incorporated herein by reference.

Following host cell transfection, cell culture supernatant is applied to a column packed with chitin resin (New England BioLabs, MA) that is equilibrated in buffer A (20 mM Tris-HCl, pH 7.5 containing 500 mM NaCl). Unbound protein is washed from the column with 10 column volumes of buffer A. Thiol reagent-induced cleavage is initiated by rapidly equilibrating the chitin resin in buffer B (20 mM Tris-HCl, pH 8 containing 0.5 M NaCl and 0.1 M 2-mercaptoethane-sulfonic acid (MESNA)). The cleavage, which simultaneously generates a C-terminal thioester on the target protein, is carried out overnight at 4° C. after which the protein was eluted from the column.

Starting with the purified Fc-thioester intermediate, native chemical ligation is carried out with cysteine or selenocysteine using the procedure in EXAMPLE 2. The final Fc-X product is purified to remove unreacted cysteine and selenocysteine by affinity chromatography with protein A sepharose.

Example 4

Preparation of Immunoglobulin Fc with N-Terminal-S-Termini and C-Terminal-X-Termini (S-Fc-X)

The S-Fc and Fc-X proteins are useful in preparing immunosymmetroadhesins having two binding domains joined to a single Fc domain (see below). Binding domains are added to the N-terminal-S-termini (S-Fc) or C-terminal-X-termini (Fc-X). S-Fc-X domains that are useful in preparing bi-symmetroadhesins with four binding domains joined to a single Fc domain are prepared using the procedures described in EXAMPLE 1 and EXAMPLE 3.

Accordingly, host cells are transfected with expression vectors that encode pre-Fc-intein chimeric polypeptides containing the M1 domain joined at its C-terminus, ELQLEESCAEAQDGELDG, by a peptide bond to the N-terminus of a self-splicing intein at the autocleavage site (FIG. 38). Heterologous signal peptides are selected from proteins with N-terminal cysteines (part i). Thus, cleavage by the cellular signal peptidase will provide a mature S-Fc-intein fusion protein having cys-5 at the N-terminus, CDKTHTCPPCP (part ii). Excision of the intein by protein splicing provides an Fc-thioester intermediate (part iii). Finally, native ligation of the Fc-thioester with free cysteine and/or selenocysteine is employed to prepare S-Fc-X proteins having the C-terminal-X-terminus, ELQLEESCAEAQDGELDGX (part iv).

The sequences of the IgG1 precursor polypeptides of FIGS. 38A-38B are shown in SEQ ID NO:126, SEQ ID NO:127, and SEQ ID NO:128. The sequence of the mature and modified IgG1 polypeptides of FIGS. 38A-38B is shown in SEQ ID NO:129 to SEQ ID NO:131.

Suitable expression vectors are constructed by ligation of an insert and vector fragment prepared by digestion with EcoRI and BglII. For unamplified expression, pSHH-Fc5-Mth is constructed with SEQ ID NO:11 and SEQ ID NO:1, pIFN-Fc5-Mth is constructed with SEQ ID NO:12 and SEQ ID NO:1, and pCETP-Fc5-Mth is constructed with SEQ ID N0:13 and SEQ ID NO:1. For amplified expression, pSHH-Fc5-Mth-DHFR is constructed with SEQ ID NO:11 and pSVeCD4DHFR, pIFN-Fc5-Mth-DHFR is constructed with SEQ ID NO:12 and pSVeCD4DHFR, and pCETP-Fc5-Mth-DHFR is constructed with SEQ ID N0:13 and pSVeCD4DHFR.

The S-Fc-intein fusion protein is first purified from the culture supernatant of transfected host cells using chitin affinity chromatography. After cleavage from the chitin resin, the Fc-thioester intermediate is directly applied to a protein A Sepharose column in order to prevent cyclization or polymerization side-reactions. The column bound activated S-Fc-thioester is used directly for native ligation with cysteine and/or selenocysteine. The column is then washed to remove excess amino acids, and the S-Fc-X is eluted from the protein A sepharose.

Example 5

Preparation of Immunoglobulin Fc with N-Terminal-X-Termini and C-Terminal-X-Termini (X-Fc-X)

The X-Fc and Fc-X proteins are useful in preparing immunosymmetroadhesins having two binding domains joined to a single Fc domain (see below). Binding domains are added to the N-terminal-X-termini (X-Fc) or C-terminal-X-termini (Fc-X). X-Fc-X domains that are useful in preparing bi-symmetroadhesins with four binding domains joined to a single Fc domain are prepared using the procedures described in EXAMPLE 2 and EXAMPLE 3.

Accordingly, host cells are transfected with expression vectors that encode pre-Fc-intein chimeric polypeptides containing the M1 domain joined at its C-terminus, ELQLEESCAEAQDGELDG, by a peptide bond to the N-terminus of a self-splicing intein at the autocleavage site (FIG. 39). Heterologous signal peptides are selected from proteins with N-terminal cysteines (part Thus, cleavage by the cellular signal peptidase will provide a mature S-Fc-intein fusion protein having cys-11 at the N-terminus (part ii). Native chemical ligation is then employed to prepare X-Fc-intein fusion proteins having cys-5 or sec-5 at the N-terminus, XDKTHTCPPCP (part iii). Excision of the intein by protein splicing provides an Fc-thioester intermediate (part iv). Finally, in a second native chemical ligation reaction, the Fc-thioester with is carried out with free cysteine and/or selenocysteine to prepare X-Fc-X proteins having a C-terminal-X-terminus ELQLEESCAEAQDGELDGX (part v). Alternately, part iii is carried following parts iv and v.

The sequences of the IgG1 precursor polypeptides of FIGS. 39A-39B are shown in SEQ ID NO:132, SEQ ID NO:133, and SEQ ID NO:134. The sequence of the mature and modified IgG1 polypeptides of FIGS. 38A-38B is shown in SEQ ID NO:135 to SEQ ID NO:138.

Suitable expression vectors are constructed by ligation of an insert and vector fragment prepared by digestion with EcoRI and BglII. For unamplified expression, plasmid pSHH-Fc11-Mth is constructed with SEQ ID NO:14 and SEQ ID NO:1, pIFN-Fc11-Mth is constructed with SEQ ID NO:15 and SEQ ID NO:1, and pCETP-Fc11-Mth is constructed with SEQ ID NO:16 and SEQ ID NO:1. For amplified expression, pSHH-Fc11-Mth-DHFR is constructed with SEQ ID NO:14 and pSVeCD4DHFR, pIFN-Fc11-Mth-DHFR is constructed with SEQ ID NO:15 and pSVeCD4DHFR, and pCETP-Fc11-Mth-DHFR is constructed with SEQ ID NO:16 and pSVeCD4DHFR.

The S-Fc-intein fusion protein is first purified from the culture supernatant of transfected host cells using chitin affinity chromatography. Native chemical ligation is carried out on the chitin column with the Msc-NH-cys$^5$-thr$^{10}$-α-thioester peptide (Fc-A) or the Msc-NH-sec$^5$-thr$^{10}$-α-thioester peptide (Fc-B) as described (EXAMPLE 2). The chitin column is then washed thoroughly to remove unreacted peptide. The intein autocleavage reaction is then carried out. After cleavage, the X-Fc-thioester intermediate is directly applied to protein A Sepharose. The bound activated X-Fc-thioester is used directly for native ligation with cysteine and/or selenocysteine. The column is then washed to remove excess amino acids. The Msc-blocked X-Fc-X is eluted from the column, treated to remove the Msc protecting group, and repurified using protein A Sepharose to yield the final X-Fc-X product.

Example 6

CD4 Symmetroadhesins

A therapeutic strategy for treating HIV-1 infection is based upon human CD4, a component of the HIV-1 receptor. CD4 immunoadhesins (Capon et al. (1989) Nature 337, 525-531) effectively block HIV-1 infectivity by binding to the gp120 envelope protein. The blocking activity resides in the CD4 extracellular domain (residues 1 to 371).

Accordingly, various CD4 symmetroadhesins are prepared using CD4-X protein, and analysed for their ability to bind gp120 and block HIV-1 infectively. The activity of CD4 symmetroadhesins is compared with CD4 immunoadhesin prepared as described (Capon et al., ibid).

CD4-X protein is prepared by the procedures of EXAMPLE 3. Host cells are transfected with expression vectors that encode the pre-CD4 chimeric polypeptide containing the CD4 extracellular domain joined at its C-terminus by a peptide bond to the N-terminus of a self-splicing intein at the autocleavage site (FIGS. 40A-40B).

Cleavage of the CD4 signal sequence (part i) by the cellular signal peptidase provides mature CD4-intein fusion protein (part ii). Excision of the intein domain provides a CD4-thioester intermediate (part iii). Finally, native chemical ligation of the CD4-thioester with free cysteine and/or selenocysteine is employed to prepare CD4 domains with C-terminal-X-termini (part iv).

The sequences of these polypeptides are shown in SEQ ID NO: 140, SEQ ID NO:141, SEQ ID NO:142, and SEQ ID NO:143.

Suitable expression vectors are constructed by ligation of an insert and vector fragment prepared by digestion with EcoRI and BglII. For unamplified expression, plasmid pCD4-Mth is constructed using SEQ ID NO:17 and SEQ ID NO:1. For amplified expression, plasmid pCD4-Mth-DHFR is constructed using SEQ ID NO:17 and pSVeCD4DHFR.

Suitable expression vectors were constructed by ligation of an insert fragment prepared by digestion with Hind III and EagI and a vector fragment prepared by digestion with Hind III and PspOM1. Plasmid pCDNA3-CD4-Mth was constructed using SEQ ID NO:139 and pCDNA3.1(+).

FIG. 56 shows expression in human 293 kidney cells of human CD4-intein fusion proteins. Lanes 1-4 show the CD4-intein fusion polypeptide of FIG. 40A (ii). Cell supernatants: lanes 1 and 3; cell lysates: lanes 2 and 4.

CD4-X is used to prepare various CD4 symmetroadhesins (Table 2). Hemi-symmetroadhesins are prepared using the CD4-X protein alone, immunosymmetroadhesins are prepared using the CD4-X protein with S-Fc, X-Fc, or Fc-X, and bi-symmetroadhesins are prepared using the CD4-X protein with S-Fc-X or X-Fc-X.

CD4 hemi-symmetroadhesin is prepared using CD4-X protein exposed to mildly reducing conditions that activate the X-termini, but do not denature the protein (Fleischman et al. (1962) Arch. Biochem. Biophys. 1 (Suppl.), 174-180; Edelman et al. (1963) Proc. Nat. Acad. Sci. (1963) 50, 753-761). CD4-X protein (0.5 to 2.0 mgs/ml) is dissolved in reducing buffer (0.05 M Tris-HCl buffer pH 8.0, made 0.1 M in 2-mercaptoethanol) and incubated for 1 hour at room temperature. The protein is then exchanged into oxidation buffer (0.1 M $K_2HPO_4$) by Sephadex G-100 chromatography, gently agitated in a round bottom glass test tube stoppered with a loosely packed cotton plug, and allowed to proceed at room temperature for 20 hours (Haber and Anfinsen (1961) J. Biol. Chem. 236, 422-424).

CD4 immunosymmetroadhesins and CD4 bi-symmetroadhesins are prepared on protein A Sepharose beads using the S-Fc, X-Fc, Fc-X, S-Fc-X, or X-Fc-X proteins as indicated (Table 2). The bound proteins are gently agitated in reducing buffer for 1 hour at room temperature, then washed with oxidation buffer. CD4-X is treated with reducing buffer, added to the beads, and the reaction allowed to proceed at room temperature for 20 hours. CD4-gp120 saturation binding analysis is carried out as described (Smith et al. (1987) Science 238, 1704-1707) using radio-iodinated gp120 prepared as described (Lasky et al. (1987) Cell 50, 975-985). Reactions (0.2) contain 0.25% NP-40, 0.1% sodium deoxycholate, 0.06 M NaCl, 0.01 M Tris-HCl, pH 8.0 (1× buffer A) with $^{125}$I-gp120 (3 ng to 670 ng at 2.9 nCi/ng). Binding is carried out for 1 hour at 0° C. in the presence or absence of 50 micrograms of unlabeled purified gp120. The bound $^{125}$I-gp120 is then determined by immunoprecipitation. Binding reactions are preabsorbed with 5 microliters of normal rabbit serum for 1 hour at 0° C., cleared with 40 microliters of 10% w/v Pansorbin (Calbiochem) for 30 minutes at 0° C., and incubated overnight at 0° C. with 2 microliters of normal serum or 5 microliters (0.25 microgram) of OKT4 monoclonal antibody (Ortho Biotech). Immunoprecipitates are collected with 10 microliters of Pansorbin, washed twice in 2× buffer and once in water, then eluted at 100° C. for 2 minutes in 0.12 M Tris-HCl pH 6.8, 4% SDS, 0.7 M mercaptoethanol. The fraction of bound $^{125}$I-gp120 is determined in a gamma counter and Scatchard analysis is used to determine the apparent dissociation constant.

HIV-1 blocking studies are carried out as described (Robert-Guroff et al. (1985) Nature 316, 72-74). Equal volumes of inhibitor and HIV-1 (60 microliters) are incubated at 4° C. for 1 hour, then the same volume of H9 cells (Gallo et al. (1984) Science 224, 500-503) at 5×10⁶/ml is added and incubation continued for 1 hour at 37° C. Following absorption of virus, 2.5×10⁵ cells in 150 microliters are transferred to 2 ml of incubation media. After 4 days at 37° C., the cultures are split 1:2 with fresh media and incubated for an additional 3 days. Cultures are harvested, reverse transcriptase activity is measured (Groopman et al., AIDS Res. Hum. Retroviruses (1987) 3, 71-85), and immunofluorescence with HIV-1 positive serum is determined as described (Poiesz et al. (1980) Proc. Acad. Nat. Sci. 77, 7415-7419). Challenge dose of virus is 100 TCID$_{50}$ of HIV-1 strain HTLV-IIIB grown in H9 cells assayed in the same system. Incubation media is RPMI 1640 media containing 2 mM L-glutamine, 100 units/ml penicillin, 100 micrograms/ml streptomycin, 2 micrograms/ml polybrene and 20% fetal calf serum.

Example 7

Tumor Necrosis Factor Receptor Symmetroadhesins

A therapeutic strategy for treating autoimmune disease is based upon tumor necrosis factor α (TNF-α), and its binding interaction with TNF-α antibodies and receptors (TNR). Both are an important therapeutic option in adult rheumatoid arthritis, juvenile rheumatoid arthritis, ankylosing spondylitis, psoriatic arthritis, Crohn's disease, and ulcerative colitis.

Accordingly, various TNR symmetroadhesins are prepared using TNR-X proteins, and analyzed for their ability to bind TNF-α and to block TNF-α biological activity. The activity of TNR symmetroadhesins is compared to that of TNR immunoadhesins (Ashkenazi et al. (1991) Proc. Natl. Acad. Sci. 88, 10535-10539).

Human TNR include TNR1A (Genbank Acc. No. NM_001065); and TNR1B (GenBank Acc. No. NM_001066). TNF-α antibody Di62 includes Di62 heavy chain (Genbank Acc. No. AJ002433); and Di62 light chain (Genbank Acc. No. AJ002434) (hereafter, TNR1A=TNR$_1$; TNR1B=TNR$_2$; and Di62-VH-CH+Di62-VkCk=TNR$_{Fab}$).

Di62-Vk is prepared according to the method of EXAMPLE 1. Di62-VH-X, TNR1A-X, and TNR1B-X, are prepared according to the method of EXAMPLE 3.

Host cells are co-transfected with two expression vectors that encode the Di62-VH-CH-intein chimeric polypeptide and Di62-VkCk protein result in co-expression of the Di62-VH-CH-intein:Di62-Vk-Ck protein that is used to prepare the TNF$_{Fab}$-X protein:
1) a pre-Di62-VH-intein chimeric polypeptide containing the Di62-VH-CH1 domain joined at its C-terminus by a peptide bond to the N-terminus of a self-splicing intein at the autocleavage site (FIGS. 41A-41B); and
2) a pre-Di62-Vk polypeptide containing the Di62-Vk-Ck domain (FIG. 42).

Cleavage of the homologous Di62-VH-CH signal sequence (part i) by the cellular signal peptidase provides mature Di62-VH-CH-intein fusion protein (part ii). Excision of the intein by protein splicing provides the Di62-VH-CH-thioester intermediate (part iii). Finally, native chemical ligation of the Di62-VH-CH-thioester with free cysteine and/or selenocysteine is employed to prepare Di62-VH-CH-X protein with C-terminal-X-termini (part iv) (refer to FIGS. 41A-41B).

Cleavage of the homologous Di62-Vk-Ck signal sequence (part i) by the cellular signal peptidase provides the mature Di62-Vk-Ck protein (part ii) (refer to FIG. 42).

Host cells are transfected with expression vectors that encode the TNR1A-intein chimeric polypeptide and TNR1B-intein chimeric polypeptide to prepare the TNF$_1$-X and TNF$_2$-X proteins, respectively:
1) a pre-TNR1A-intein chimeric polypeptide containing the TNR1A extracellular domain joined at its C-terminus by a peptide bond to the N-terminus of a self-splicing intein at the autocleavage site (FIG. 43); and
2) a pre-TNR1B-intein chimeric polypeptide containing the TNR1B extracellular domain joined at its C-terminus by a peptide bond to the N-terminus of a self-splicing intein at the autocleavage site (FIG. 44A).

Cleavage of the homologous TNR signal sequences (part i) by the cellular signal peptidase provides mature TNR-intein fusion proteins (part ii). Excision of the intein by protein splicing provides TNR-thioester intermediates (part iii). Finally, native chemical ligation of the TNR-thioesters with free cysteine and/or selenocysteine is employed to prepare TNR-X proteins with C-terminal-X-termini (part iv) (refer to FIG. 43, 44A).

The sequences of these polypeptides are shown in SEQ ID NO: 145, SEQ ID NO:146, SEQ ID NO:147, and SEQ ID NO:148 (Di62-VHCH); in SEQ ID NO: 150, and SEQ ID NO:151 (D162-VkCk); in SEQ ID NO: 153, SEQ ID NO:154, SEQ ID NO:155, and SEQ ID NO:156 (TNR1A); in SEQ ID NO: 158, SEQ ID NO:159, SEQ ID NO:160, and SEQ ID NO:161 (TNR1B); and in SEQ ID NO: 163, and SEQ ID NO:164 (TNR1B immunoadhesin).

Suitable expression vectors are constructed by ligation of an insert and vector fragment prepared by digestion with EcoRI and BglII. For unamplified expression, plasmid pDi62-VHCH-Mth is constructed using SEQ ID NO:18 and SEQ ID NO:1, plasmid pDi62-VkCk is constructed using SEQ ID NO:19 and SEQ ID NO:1, plasmid pTNR1A-Mth is constructed using SEQ ID NO:20 and SEQ ID NO:1, and plasmid pTNR1A-Mth is constructed using SEQ ID NO:22 and SEQ ID NO:1. For amplified expression, plasmid pDi62-VHCH-Mth-DHFR is constructed using SEQ ID NO:18 and pSVeCD4DHFR, plasmid pDi62-VkCk-DHFR is constructed using SEQ ID NO:19 and pSVeCD4DHFR, plasmid pTNR1A-Mth-DHFR is constructed using SEQ ID NO:20 and pSVeCD4DHFR, and plasmid pTNR1A-Mth-DHFR is constructed using SEQ ID NO:22 and pSVeCD4DHFR.

Suitable expression vectors are constructed by ligation of an insert fragment prepared by digestion with Hind III and EagI and a vector fragment prepared by digestion with Hind III and PspOM1. Plasmid pCDA3-Di62-VHCH-Mth is constructed using SEQ ID NO:144 and pCDNA3.1(+). Plasmid pCDA3-Di62-VkCk is constructed using SEQ ID NO:149 and pCDNA3.1(+). Plasmid pCDNA-3-TNR1A-Mth-DHFR is constructed using SEQ ID NO:152 and pCDNA3.1 (+). Plasmid pCDNA-3-TNR1B-Mth-DHFR was constructed using SEQ ID NO:157 and pCDNA3.1(+). Plasmid pCDNA-3-TNR1B-immunoadhesin was constructed using SEQ ID NO:162 and pCDNA3.1(+).

FIG. 57 shows the expression in human 293 kidney cells of human TNR1B fusion proteins. Lanes 2 and 5 show the TNR1B-intein fusion protein of FIG. 44A (ii). Lanes 1 and 3 show the TNR1B-immunoadhesin fusion protein of FIG. 44B (ii). Lanes 3 and 6 show proteins from mock-transfected cells. Cell supernatants: lanes 1-3; cell lysates: lanes 4-7. Lane 7: control TNR1B-immunoadhesin (R&D Systems).

FIG. 58 shows TNR1B symmetroadhesin subunits with C-terminal-S-termini. Lanes 1-2 show the TNR1B polypeptide of FIG. 44A (iii) following purification by chitin affinity chromatography and cleavage/elution with MESNA. Lanes 3 shows the native ligation product between the TNR1B polypeptide of FIG. 44A (iii) with a fluorescent-labeled peptide (New England Biolabs). Panel (i): direct fluorescence; panel (ii): western blot with anti-TNR1B antibody (R&D Systems); panel (iii): SYPRO Ruby staining (Sigma-Aldrich).

FIG. 59 shows TNR1B symmetroadhesin subunits with C-terminal-S-termini. Lane 5 shows the TNR1B polypeptide of FIG. 44A (iv) following purification by chitin affinity chromatography and cleavage/elution with cysteine. Lanes 1-4 show TNR1B-immunoadhesin.

FIG. 60 shows TNR1B symmetroadhesin. Lanes 1-4 show the TNR1B symmetroadhesin of FIG. 44A (iv) before oxidation (lanes 1 and 4) and after oxidation in the presence of 10 mM CuSO4. Lanes 3 and 6 show a TNR1B-immunoadhesin control. Lanes 1-3: reducing conditions; lanes 4-6: non-reducing conditions. The TNR1B symmetroadhesin monomer (42 kd) and dimer (84 kd) are apparent in lanes 2 and 5, and lane 5, respectively.

FIGS. 61A-61C show TNF-alpha saturation binding analysis with various TNR1B polypeptides on the Biacore T-100. (A) The TNR1B symmetroadhesin of FIG. 44A (iv) was covalently coupled to a Biacore CM-5 chip using standard Biacore amine chemistry. (B) TNR1B immunoadhesin (R&D Systems) was covalently coupled to a Biacore CM-5 chip using standard Biacore amine chemistry. (C) The TNR1B symmetroadhesin of FIG. 44A (iv) was covalently coupled to a Biacore CM-5 chip using standard Biacore thiol chemistry. Following coupling, saturation binding analysis was carried out using TNF-alpha (R&D Systems) at the indicated concentrations.

FIGS. 62A-62C shows Scatchard analysis of the TNF-alpha saturation binding analysis shown in FIG. 61A-61C. (A) TNR1B symmetroadhesin of FIG. 44A (iv) covalently coupled using amine chemistry; Kd=Kd=$4.697\times10^{-9}$ M. (B) TNR1B-immunoadhesin (R&D Systems) covalently coupled using amine chemistry; Kd=$4.089\times10^{-9}$ M. (C) TNR1B symmetroadhesin of FIG. 44A (iv) covalently coupled using thiol chemistry; Kd=$0.8476\times10^{-9}$ M.

The $TNR_1$-X, $TNR_2$-X, and $TNR_{Fab}$-X proteins, individually and in various combinations, are used to prepare various VGFR symmetroadhesins (Tables 3, 4, and 5). The number of distinct configurations obtained for each combination, as well as the general structure for each, is also shown.

Hemi-symmetroadhesins are prepared using the TNR-X proteins alone, immunosymmetroadhesins are prepared using the TNR-X proteins with S-Fc, X-Fc, or Fc-X, and bi-symmetroadhesins are prepared using the TNR-X proteins with S-Fc-X or X-Fc-X.

Each TNR-X protein or TNR symmetroadhesin is determined by a quantitative immunoassay using subtype-specific, affinity-purified polyclonal antibodies to TNR1A, TNR1B, and Di62 (goat-anti-mouse), and immunoadhesins (TNR1A-Ig and TNR2A-Ig) as reference standards. TNR antibodies, TNR-Ig immunoadhesins, and TNF-α protein are obtained from R&D Systems (MN).

Binding of TNGR symmetroadhesins to TNF-α is studied as described (Ashkenazi et al. (1991) Proc. Natl. Acad. Sci. 88, 10535-10539). Individual samples (1 microgram/ml) are immobilized onto microtiter wells coated with goat-anti-human Ig Fc antibody. Reactions with recombinant human $^{125}$I-TNF-α (radiodinated by using lactoperoxidase to a specific activity of 19.1 microCi/microgram; 1 microCi=37 kBq) are done in phosphate-buffered saline (PBS) containing 1% bovine serum albumin for 1 hour at 24° C. Non-specific binding is determined by omitting the sample. In competition binding analyses, $^{125}$I-TNF-α is incubated with immobilized samples in the presence of increasing concentrations of unlabeled TNF-α. The $K_d$ is determined from competition $IC_{50}$ values according to the following equation: $K_d=IC_{50}/(1+[T]/K_{dT})$, where [T] is the concentration of the tracer (0.1 nm) and $K_{dT}$ is the $K_d$ of the tracer determined by saturation binding (80 pM).

TNF cytotoxity is studied as described (Kawade and Watanabe (1984) J. Interferon Res. 4, 571-584). Mouse L-M cells are plated in microtiter dishes ($4\times10^4$ cells per well) and treated with actinomycin D (3 micrograms/ml) and TNF-α or TNF-β (1 nanogram/ml) in the presence or absence of the sample or other inhibitors. After 20 hours of incubation at 39° C., the cell survival is determined by a crystal violet dye exclusion test.

A mouse model for septic shock is studied by endotoxin injection of 6- to 8-week-old BALB/c mice. Animals are injected intravenously (i.v.) with an $LD_{100}$ dose of *Salmonella abortus*-derived endotoxin (175 micrograms per mouse) in phosphate-buffered saline (PBS), and survival is followed for at least 78 hour. TNR1-immunoadhesin and CD4-immunoadhesin are used as the positive and negative controls, respectively. Each is diluted in PBS and injected i.v. prior to, or after, the administration of endotoxin.

Example 8

Vascular Endothelial Growth Factor Receptor Symmetroadhesins

A therapeutic strategy for treating angiogenic disease is based upon vascular endothelial growth factors (VEGF) and their binding interaction with VEGF receptors (VGFR). VEGF-antibodies and VGFR-immunoadhesins are promising candidates for treatment in a number of metastatic carcinomas including colon, rectum, lung, and breast, and in age-related macular degeneration.

Accordingly, various VGFR symmetroadhesins are prepared using VGFR-X proteins, and analyzed for their ability to bind VEGF and to block VEGF biological activity. The activity of VGFR symmetroadhesins is compared to that of VGRF immunoadhesins (Park et al. (1994) J. Biol. Chem. 269, 25646-25654).

Human VGFR include VGFR1 (Genbank Acc. No. NM_002019); VGFR2 (GenBank Acc. No. NM_002253); and VGFR3 (GenBank Acc. No. NM_002020). VGFR1-X, VGFR2-X, and VGFR3-X are prepared according to the method of EXAMPLE 3. Host cells are transfected with expression vectors that encode:

1) a pre-VGFR1-intein chimeric polypeptide containing the VGFR1 extracellular domain joined at its C-terminus by a peptide bond to the N-terminus of a self-splicing intein at the autocleavage site (FIGS. 45A-45C);

2) a pre-VGFR2-intein chimeric polypeptide containing the VGFR1 extracellular domain joined at its C-terminus by a peptide bond to the N-terminus of a self-splicing intein at the autocleavage site (FIGS. 46A-46C); and 3) a pre-VGFR1-intein chimeric polypeptide containing the VGFR1 extracellular domain joined at its C-terminus by a peptide bond to the N-terminus of a self-splicing intein at the autocleavage site (FIGS. 47A-47C).

Cleavage of the VGFR signal sequence (part i) by the cellular signal peptidase provides mature VGFR-intein fusion proteins (part ii). Excision of the intein domain provides a VGFR-thioester intermediate (part iii). Finally, native chemical ligation of the VGFR-thioester with free cysteine and/or selenocysteine is employed to prepare VGFR domains with C-terminal-X-termini (part iv).

The sequences of these polypeptides are shown in SEQ ID NO: 166, SEQ ID NO:167, SEQ ID NO:168, and SEQ ID NO:169 (VGFR1); in SEQ ID NO: 171, SEQ ID NO:172, SEQ ID NO:173, and SEQ ID NO:174 (VGFR2); and in SEQ ID NO: 176, SEQ ID NO:177, SEQ ID NO:178, and SEQ ID NO:179 (VGFR3).

Suitable expression vectors are constructed by ligation of an insert and vector fragment prepared by digestion with EcoRI and BglII. For unamplified expression, plasmid pVGFR1-Mth is constructed using SEQ ID NO:22 and SEQ ID NO:1, plasmid pVGR1-Mth is constructed using SEQ ID NO:23 and SEQ ID NO:1, and plasmid pVGR1-Mth is constructed using SEQ ID NO:24 and SEQ ID NO:1. For unamplified expression, plasmid pVGFR1-Mth-DHFR is constructed using SEQ ID NO:22 and pSVeCD4DHFR, plasmid pVGR1-Mth-DHFR is constructed using SEQ ID NO:23 and pSVeCD4DHFR, and plasmid pVGR1-Mth-DHFR is constructed using SEQ ID NO:24 and pSVeCD4DHFR.

Suitable expression vectors are constructed by ligation of an insert fragment prepared by digestion with Hind III and EagI and a vector fragment prepared by digestion with Hind III and PspOM1. Plasmid pCDNA3-VGFR1-Mth is constructed using SEQ ID NO:165 and pCDNA3.1(+). Plasmid pCDNA3-VGFR2-Mth is constructed using SEQ ID NO:170 and pCDNA3.1(+). Plasmid pCDNA3-VGFR3-Mth is constructed using SEQ ID NO:175 and pCDNA3.1 (+).

The VGFR1-X, VGFR2-X, and VEGFR3-X proteins, individually and in various combinations, are used to prepare various VGFR symmetroadhesins (Tables 6, 7, and 8). The number of distinct configurations obtained for each combination, as well as the general structure for each, is also shown. Hemi-symmetroadhesins are prepared using the VGFR-X proteins alone, immunosymmetroadhesins are prepared using the VGFR-X proteins with S-Fc, X-Fc, or Fc-X, and bi-symmetroadhesins are prepared using the VGFR-X proteins with S-Fc-X or X-Fc-X.

Each VGFR-X protein or VGFR symmetroadhesin is determined by a quantitative immunoassay using subtype-specific, affinity-purified polyclonal antibodies to VGFR1, VGFR2, and VGFR3, and immunoadhesins (VGFR1-Ig, VGFR2-Ig, and VGFR3-Ig) as reference standards. VGFR antibodies, VGFR-Ig immunoadhesins, and $VEGF_{165}$ protein are obtained from R&D Systems (MN).

Binding of VEGR symmetroadhesins to VEGF is studied using a VEGF saturation binding assay. Reactions (0.1 ml) contain 10% fetal bovine serum in PBS (buffer A) with $^{125}I-VEGF_{165}$ (<9000 cpm/well, $5.69\times10^7$ cpm/microgram). Chloramine T is used to iodinated $VEGF_{165}$ as described (Keyt et al. (1996) J. Biol Chem. 271, 5638-5646). Binding is carried out overnight at 4° C. in the presence or absence of 50 nanograms of unlabeled purified $VEGF_{165}$. The bound $^{125}I-VEGF_{165}$ is then determined by capture in 96-well breakaway immunoabsorbent assay plates (Nunc). Plates are coated, overnight at 4° C. with 2 micrograms/ml affinity-purified goat anti-human Fc IgG (Organon-Teknika) in 50 mM $Na_2CO_3$, pH 9.6, and preblocked for 1 hr in buffer A. Binding reactions are then incubated in the coated wells for 4 hrs at room temperature, followed by 4 washes with buffer A. The fraction of bound $^{125}I-VEGF_{165}$ is determined in a gamma counter. Data is analyzed using a 4-parameter non-linear curve fitting program (Kalidagraph, Abelbeck Software, PA).

Binding of VEGF to VEGR symmetroadhesins is also studied using a competition binding assay. ELISA plates are coated with 2 micrograms/ml rabbit $F(ab')_2$ to human IgG Fc (Jackson ImmunoResearch, PA) and blocked with buffer A. KDR-IgG (3 nanograms/ml) in buffer A is added to the plate and incubated for 1 hr. Serially-diluted samples are incubated with 2 nM biotinylated VEGF for 1 h in tubes. The reactions are then transferred to the ELISA plates and incubated for 1 h. After washing, the fraction of biotinylated VEGF bound to KDR-Ig is detected using horseradish peroxidase-labeled streptavidin (Sigma, MO) followed by 3,3',5,5'-tetramethylbenzidine substrate. Data is analyzed using 4-parameter non-linear regression curve fitting analysis.

Endothelial cell growth inhibition studies are carried out as described (Leung et al. (1989) Science 246, 1306-1309). Bovine adrenal cortex capillary endothelial cells are cultured in the presence of low glucose Dulbecco's modified Eagle's medium (GIBCO) supplemented with 10% calf serum, and 2 mM glutamine (growth medium). Cells are seeded at a density of $6\times10^3$ cells/well in 6-well plates. Serially diluted samples are added to the cells at concentrations between 1 to 5000 nanograms/ml and incubated for 2 to 3 hr. Purified $VEGF_{165}$ is added to a final concentration of 3 nanograms/ml. Cells are then incubated for 5 to 6 days, removed from plates with trypsin, and cell number determined in a Coulter counter (Coulter Electronics, FL). Data is analyzed using 4-parameter non-linear regression curve fitting analysis.

In vivo tumor studies are carried out as described (Kim et al. (1993) Nature 362, 841-844; Borgstrom at al. (1996) Cancer Res. 56, 4032-4039). Human A673 rhabdomyosarcoma cells (ATCC CRL-1598) are cultured in DMEM/F12 supplemented with 10% fetal bovine serum, and 2 mM glutamine. Female BALB/c nude mice, 6 to 10 weeks old, are injected subcutaneously with $2\times10^6$ tumor cells in the dorsal area in a volume of 200 microliters. Following tumor cell inoculation (24 hr.), animals (10 per group) are treated with serially diluted samples at doses of 0.05 mg/kg, 0.5 mg/kg, and 5 mg/kg, administered twice weekly intraperitoneally in a volume of 0.1 ml. Tumor size is determined at weekly intervals. Four weeks after tumor cell inoculation, animals are euthanized and the tumors removed and weighed. Statistical analysis is carried out by ANOVA.

Example 9

ErbB Symmetroadhesins

A therapeutic strategy for treating malignant disease is based upon epidermal growth factor-like receptors (ErbB) and their ligands, including the neuregulins/heregulins (NRG/HRG), and the family of EGF-related protein ligands. ErbB-antibodies and ErbB-immunoadhesins are under clinical investigation, and are well-proven in treating metastatic breast cancers overexpressing ErbB2.

Accordingly, various ErbB symmetroadhesins are prepared using ErbB-X proteins, and analyzed for their ability to bind heregulins and block heregulin biological activity. The activity of ErbB symmetroadhesins is compared to that of ErbB immunoadhesins (Sliwkowski et al. (1994) J. Biol. Chem. 269, 14661-14665).

Human ErbB include ErbB1 (Genbank Acc. No. NM_005228); ErbB2 (GenBank Acc. No. NM_004448); ErbB3 (GenBank Acc. No. NM_001982); and ErbB4 (GenBank Acc. No. NM_005235). ErbB1-X, ErbB2-X, ErbB3-X, and ErbB4-X are prepared according to the method of EXAMPLE 3. Host cells are transfected with expression vectors that encode:

1) a pre-ErbB1-intein chimeric polypeptide containing the ErbB1 extracellular domain joined at its C-terminus by a peptide bond to the N-terminus of a self-splicing intein at the autocleavage site (FIGS. 48A-48B);

2) a pre-ErbB2-intein chimeric polypeptide containing the ErbB2 extracellular domain joined at its C-terminus by a peptide bond to the N-terminus of a self-splicing intein at the autocleavage site (FIGS. 49A-49B);

3) a pre-ErbB3-intein chimeric polypeptide containing the ErbB3 extracellular domain joined at its C-terminus by a peptide bond to the N-terminus of a self-splicing intein at the autocleavage site (FIGS. 50A-50B); and 4) a pre-ErbB4-intein chimeric polypeptide containing the ErbB4 extracellular domain joined at its C-terminus by a peptide bond to the N-terminus of a self-splicing intein at the autocleavage site (FIGS. 51A-50B).

Cleavage of the homologous ErbB signal sequence (part i) by the cellular signal peptidase provides mature ErbB-intein fusion proteins (part ii). Excision of the intein domain by protein splicing provides a ErbB-thioester intermediate (part iii). Finally, native chemical ligation of the ErbB-thioester with free cysteine and/or selenocysteine is employed to prepare VEGR domains with C-terminal-X-termini (part iv).

The sequences of these polypeptides are shown in SEQ ID NO: 181, SEQ ID NO:182, SEQ ID NO:183, and SEQ ID NO:184 (ERBB1); in SEQ ID NO: 186, SEQ ID NO:187, SEQ ID NO:188, and SEQ ID NO:189 (ERBB2); in SEQ ID NO: 191, SEQ ID NO:192, SEQ ID NO:193, and SEQ ID NO:194 (ERBB3); and in SEQ ID NO: 196, SEQ ID NO:197, SEQ ID NO:198, and SEQ ID NO:199 (ERBB4).

Suitable expression vectors are constructed by ligation of an insert and vector fragment prepared by digestion with EcoRI and BglII. For unamplified expression, plasmid pErbB1-Mth is constructed using SEQ ID NO:25 and SEQ ID NO:1, plasmid pErbB2-Mth is constructed using SEQ ID NO:26 and SEQ ID NO:1, plasmid pErbB3-Mth is constructed using SEQ ID NO:27 and SEQ ID NO:1, and plasmid pErbB4-Mth is constructed using SEQ ID NO:28 and SEQ ID NO:1. For amplified expression, plasmid pErbB1-Mth-DHFR is constructed using SEQ ID NO:25 and pSVeCD4DHFR, plasmid pErbB2-Mth-DHFR is constructed using SEQ ID NO:26 and pSVeCD4DHFR, plasmid pErbB3-Mth-DHFR is constructed using SEQ ID NO:27 and pSVeCD4DHFR, and plasmid pErbB4-Mth-DHFR is constructed using SEQ ID NO:28 and pSVeCD4DHFR.

Suitable expression vectors are constructed by ligation of an insert fragment prepared by digestion with Hind III and EagI and a vector fragment prepared by digestion with Hind III and PspOM1. Plasmid pCDNA3-ERBB1-Mth is constructed using SEQ ID NO:180 and pCDNA3.1(+). Plasmid pCDNA3-ERBB2-Mth is constructed using SEQ ID NO:185 and pCDNA3.1(+). Plasmid pCDNA3-ERBB3-Mth is constructed using SEQ ID NO:190 and pCDNA3.1(+). Plasmid pCDNA3-ERBB4-Mth is constructed using SEQ ID NO:195 and pCDNA3.1(+).

The ErbB1-X, ErbB2-X, ErbB3-X and ErbB4-X proteins, individually and in various combinations, are used to prepare various VGFR symmetroadhesins (Tables 9, 10, 11). The number of distinct configurations obtained for each combination, as well as the general structure for each, is also shown.

Hemi-symmetroadhesins are prepared using the ErbB-X proteins alone, immunosymmetroadhesins are prepared using the ErbB-X proteins with S-Fc, X-Fc, or Fc-X, and bi-symmetroadhesins are prepared using the ErbB-X proteins with S-Fc-X or X-Fc-X.

Each ErbB-X protein or ErbB symmetroadhesin is determined by a quantitative immunoassay using subtype-specific, affinity-purified polyclonal antibodies to ErbB1, ErbB2, ErbB3, and ErbB4, and immunoadhesins (ErbB1-Ig, ErbB2-Ig, ErbB3-Ig, and ErbB4-Ig) as reference standards. ErbB antibodies, ErbB-Ig immunoadhesins, NRG1-$\alpha_{177-241}$ protein, NRG1-$\beta_{176-246}$ protein, NRG1-$\beta_{1-246}$ protein, and NRG1-SMDF$_{1-296}$ protein are obtained from R&D Systems (MN).

Binding of ErbB symmetroadhesins to neuregulins is studied using a HRG saturation binding assay (Sliwkowski et al. (1994) J. Biol. Chem. 269, 14661-14665). Reactions are performed in Nunc breakapart immuno-module plates. Plate wells are coated at 4° C. overnight with 100 microliters of 5 micrograms/ml goat-anti-human antibody (Boehringer Mannheim) in 50 mM carbonate buffer (pH 9.6). Plates are rinsed twice with 200 microliters wash buffer (PBS/0.05% Tween-20™) followed by a brief incubation with 100 microliters 1% BSA/PBS for 30 min at room temperature. Buffer is removed and each well is incubated with 100 microliters of the sample in 1% BSA/PBS under vigorous side-to-side rotation for 1 hour. Plates are rinsed three times with wash buffer and competitive binding is carried out by adding various amounts of cold competitor gamma-HRG and $^{125}$I-HRGβ1 and incubating at room temperature for to 3 hours with vigorous side-to-side rotation. Wells are quickly rinsed three times with wash buffer, drained and individual wells are counted in a gamma-counter.

Scatchard analysis is performed using a modified Ligand program (Munson, P. and Robard, D. (1980) Analytical Biochemistry 107:220-239).

The ability of ErbB symmetroadhesins to inhibit HRG-dependent proliferation is studied in the MCF7 breast carcinoma cell line (Lewis et al. (1996) Cancer Res. 56, 1457-1465). $^3$H-thymidine incorporation is are carried out in 96-well format. Serum-starved MCF7-7 cells are plated at 10,000 cells/well in 50:50 F12/DMEM (high glucose). Varying concentrations of sample are incubated with 1 nM HRG and added to the cells. After a 15 hour incubation, cells are labeled with $^3$H-thymidine to measure DNA synthesis (20 mL of 1/20 diluted tritiated thymidine stock: Amersham TRA 120 B363, 1 mCi/ml). Cells are then harvested onto GF/C unifilters (96 well format) using a Packard Filtermate 196 harvester. Filters are counted using a Packard Topcount apparatus.

Screening

This invention is particularly useful for screening compounds by using consecutive amino acid sequences/or compounds comprising such in any of a variety of drug screening techniques. The compound employed in such a test may either be free in solution, affixed to a solid support, borne on a cell surface, or located intracellularly. One method of drug screening utilizes eukaryotic or prokaryotic host cells which are stably transformed with recombinant nucleic acids expressing the compound. Drugs are screened against such transformed cells in competitive binding assays. Such cells, either in viable or fixed form, can be used for standard binding assays. One may measure, for example, the formation of complexes between compound or a fragment and the agent being tested. Alternatively, one can examine the diminution in complex formation between the compound and its target cell or target receptors caused by the agent being tested.

Thus, the present invention provides methods of screening for drugs or any other agents which can affect a disease or disorder associated with a stretch of consecutive amino acids of the compound. These methods comprise contacting such an agent with the compound or fragment thereof and assaying (I) for the presence of a complex between the agent and the compound or fragment thereof, or (ii) for the presence of a complex between the compound or fragment thereof and the cell, by methods well known in the art. In such competitive binding assays, the compound or fragment thereof is typically labeled. After suitable incubation, free compound or fragment thereof is separated from that present in bound form, and the amount of free or uncomplexed label is a measure of the ability of the particular agent to bind to the compound or fragment thereof or to interfere with the compound/cell complex.

Another technique for drug screening provides high throughput screening for compounds having suitable binding affinity to a polypeptide and is described in detail in WO 84/03564, published on Sep. 13, 1984. Briefly stated, large numbers of different small peptide test compounds are synthesized on a solid substrate, such as plastic pins or some other surface. As applied to the instant compound or fragment thereof, the peptide test compounds are reacted with compound or fragment thereof and washed. Bound compound or fragment thereof is detected by methods well known in the art. Purified compound or fragment thereof can also be coated directly onto plates for use in the aforementioned drug screening techniques. In addition, non-neutralizing antibodies can be used to capture the peptide and immobilize it on the solid support.

This invention also contemplates the use of competitive drug screening assays in which neutralizing antibodies capable of binding compound or fragment thereof specifically compete with a test compound for binding to compound or fragment thereof. In this manner, the antibodies can be used to detect the presence of any peptide which shares one or more antigenic determinants with the stretch(es) of consecutive amino acids of the compound.

Rational Drug Design

The goal of rational drug design is to produce structural analogs of biologically active polypeptide of interest (i.e., a compound of the invention, or an amino acid sequence of a compound of the invention) or of small molecules with which they interact, e.g., agonists, antagonists, or inhibitors. Any of these examples can be used to fashion drugs which are more active or stable forms of the a compound of the invention, or an amino acid sequence of a compound of the invention or which enhance or interfere with the function of the a compound of the invention, or an amino acid sequence of a compound of the invention in vivo (cf., Hodgson, Bio/Technology, 9:19-21 (1991)).

In one approach, the three-dimensional structure of a compound of the invention, or an amino acid sequence of a compound of the invention, or of a compound-inhibitor complex, is determined by x-ray crystallography, by computer modeling or, most typically, by a combination of the two approaches. Both the shape and charges of a compound of the invention, or an amino acid sequence of a compound of the invention, must be ascertained to elucidate the structure and to determine active site(s). Relevant structural information is used to then design analogous molecules or to identify efficient inhibitors. Useful examples of rational drug design may include molecules which have improved activity or stability as shown by Braxton and Wells, Biochemistry, 31:7796-7801 (1992) or which act as inhibitors, agonists, or antagonists of native peptides as shown by Athauda et al., J. Biochem., 113:742-746 (1993).

It is also possible to isolate a target-specific antibody, selected by functional assay, as described above, and then to solve its crystal structure. This approach, in principle, yields a pharmacore upon which subsequent drug design can be based. It is possible to bypass protein crystallography altogether by generating anti-idiotypic antibodies (anti-ids) to a functional, pharmacologically active antibody. As a mirror image of a mirror image, the binding site of the anti-ids would be expected to be an analog of the original receptor. The anti-id could then be used to identify and isolate peptides from banks of chemically or biologically produced peptides. The isolated peptides would then act as the pharmacore.

By virtue of the present invention, sufficient amounts of the compounds of the invention, or an amino acid sequence of a compound of the invention may be made available to perform such analytical studies as X-ray crystallography.

Assays of Biological Activity

The compounds disclosed herein, including components thereof such as a stretch of consecutive amino acids of a compound, are readily assayed using one or more standard assays of biological activity known to those in the art. The following are non-limiting examples of such assays:

Ability of the Compounds to Inhibit Vascular Endothelial Growth Factor (VEGF) Stimulated Proliferation of Endothelial Cell Growth The ability of the various compounds of this invention to inhibit VEGF stimulated proliferation of endothelial cells was tested. Positive testing in this assay indicates the compound is useful for inhibiting endothelial cell growth in mammals where such an effect would be beneficial, e.g., for inhibiting tumor growth.

In a specific example of the assay, bovine adrenal cortical capillary endothelial cells (ACE) (from primary culture, maximum of 12-14 passages) are plated in 96-well plates at 500 cells/well per 100 microliter. Assay media includes low glucose DMEM, 10% calf serum, 2 mM glutamine, and 1× penicillin/streptomycin/fungizone. Control wells include the following: (1) no ACE cells added; (2) ACE cells alone; (3) ACE cells plus 5 ng/ml FGF; (4) ACE cells plus 3 ng/ml VEGF; (5) ACE cells plus ng/ml VEGF plus 1 ng/ml TGF-beta; and (6) ACE cells plus 3 ng/ml VEGF plus 5 ng/ml LIF. The test samples, poly-his tagged compounds (in 100 microliter volumes), are then added to the wells (at dilutions of 1%, 0.1% and 0.01%, respectively). The cell cultures are incubated for 6-7 days at 37° C./5% $CO_2$ After the incubation, the media in the wells is aspirated, the cells are washed 1× with PBS. An acid phosphatase reaction mixture (100 microliter; 0.1M sodium acetate, pH 5.5, 0.1% Triton X-100, 10 mM p-nitrophenyl phosphate) is then added to each well. After a 2 hour incubation at 37° C., the reaction is stopped by addition of 10 microliters 1M NaOH. Optical density (OD) is measured on a microplate reader at 405 nm.

The activity of the assayed compound is calculated as the percent inhibition of VEGF (3 ng/ml) stimulated proliferation (as determined by measuring acid phosphatase activity at OD 405 nm) relative to the cells without stimulation. TGF-beta can be employed as an activity reference at 1 ng/ml, since TGF-beta blocks 70-900 of VEGF-stimulated ACE cell proliferation. The results are indicative of the utility of the assayed compound in cancer therapy and specifically in inhibiting tumor angiogenesis. Numerical values (relative inhibition) are determined by calculating the percent inhibition of VEGF stimulated proliferation by the assayed compound relative to cells without stimulation and then dividing that percentage into the percent inhibition obtained by TGF-beta at 1 ng/ml which is known to block 70-90% of VEGF stimulated cell proliferation. The results are considered positive if the assayed compound exhibits 30% or greater inhibition of VEGF stimulation of endothelial cell growth (relative inhibition 30% or greater).

Retinal Neuron Survival

This assay can demonstrate if the compound tested has efficacy in enhancing the survival of retinal neuron cells and, therefore, is useful for the therapeutic treatment of retinal disorders or injuries including, for example, treating sight loss in mammals due to retinitis pigmentosum, AMD, etc.

Sprague Dawley rat pups at postnatal day 7 (mixed population: glia and retinal neuronal types) are killed by decapitation following $CO_2$ anesthesia and the eyes are removed under sterile conditions. The neural retina is dissected away from the pigment epithelium and other ocular tissue and then dissociated into a single cell suspension using 0.25% trypsin in $Ca^{2+}$, $Mg^{2+}$-free PBS. The retinas are incubated at 37° C. for 7-10 minutes after which the trypsin is inactivated by adding 1 ml soybean trypsin inhibitor. The cells are plated at 100,000 cells per well in 96 well plates in DMEM/F12 supplemented with $N_2$ and with or without the specific test compound. Cells for all experiments are grown at 37° C. in a water saturated atmosphere of 5% $CO_2$. After 2-3 days in culture, cells are stained with calcein AM then fixed using 4% paraformaldehyde and stained with DAPI for determination of total cell count. The total cells (fluorescent) are quantified at 20× objective magnification using CCD camera and NIH image software for MacIntosh. Fields in the well are chosen at random.

The effect of various concentration of the tested compound are reported herein where percent survival is calculated by dividing the total number of calcein AM positive cells at 2-3 days in culture by the total number of DAPI-labeled cells at 2-3 days in culture. Anything above 30% survival is considered positive.

Rod Photoreceptor Cell Survival

This assay is used to show whether certain compounds of the invention act to enhance the survival/proliferation of rod photoreceptor cells and, therefore, are useful for the therapeutic treatment of retinal disorders or injuries including, for example, treating sight loss in mammals due to retinitis pigmentosum, AMD, etc. Sprague Dawley rat pups at 7 day postnatal (mixed population: glia and retinal neuronal cell types) are killed by decapitation following $CO_2$ anesthesia and the eyes are removed under sterile conditions. The neural retina is dissected away form the pigment epithelium and other ocular tissue and then dissociated into a single cell suspension using 0.25% trypsin in $Ca^{2+}$, $Mg^{2+}$-free PBS. The retinas are incubated at 37° C. for 7-10 minutes after which the trypsin is inactivated by adding 1 ml soybean trypsin inhibitor. The cells are plated at 100,000 cells per well in 96 well plates in DMEM/F12 supplemented with $N_2$. Cells for all experiments are grown at 37° C. in a water saturated atmosphere of 5% $CO_2$. After 2-3 days in culture, cells are fixed using 4% paraformaldehyde, and then stained using CellTracker Green CMFDA. Rho 4D2 (ascites or IgG 1:100), a monoclonal antibody directed towards the visual pigment rhodopsin is used to detect rod photoreceptor cells by indirect immunofluorescence. The results are calculated as % survival: total number of calcein-rhodopsin positive cells at 2-3 days in culture, divided by the total number of rhodopsin positive cells at time 2-3 days in culture. The total cells (fluorescent) are quantified at 20× objective magnification using a CCD camera and NIH image software for MacIntosh. Fields in the well are chosen at random.

Induction of Endothelial Cell Apoptosis

The ability of the compounds disclosed herein to induce apoptosis in endothelial cells can be tested in human venous umbilical vein endothelial cells (HUVEC, Cell Systems). A positive test in the assay is indicative of the usefulness of the compound in therapeutically treating tumors as well as vascular disorders where inducing apoptosis of endothelial cells would be beneficial.

The cells are plated on 96-well microtiter plates (Amersham Life Science, cytostar-T scintillating microplate, RPNQ160, sterile, tissue-culture treated, individually wrapped), in 10% serum (CSG-medium, Cell Systems), at a density of $2×10^4$ cells per well in a total volume of 100 µl. On day 2, test samples containing the tested compound are added in triplicate at dilutions of 1%, 0.33% and 0.11%. Wells without cells were used as a blank and wells with cells only are used as a negative control. As a positive control 1:3 serial dilutions of 50 µl of a 3× stock of staurosporine were used. The ability of the compound to induce apoptosis is determined by processing of the 96 well plates for detection of Annexin V, a member of the calcium and phospholipid binding proteins, to detect apoptosis.

0.2 ml Annexin V—Biotin stock solution (100 µg/ml) was diluted in 4.6 ml 2× $Ca^{2+}$ binding buffer and 2.5% BSA (1:25 dilution). 50 µl of the diluted Annexin V—Biotin solution was added to each well (except controls) to a final concentration of 1.0 µg/ml. The samples were incubated for 10-15 minutes with Annexin-Biotin prior to direct addition of $^{35}$S-Streptavidin. S-Streptavidin was diluted in 2× $Ca^{2+}$ Binding buffer, 2.5% BSA and was added to all wells at a final concentration of $3×10^4$ cpm/well. The plates were then sealed, centrifuged at 1000 rpm for 15 minutes and placed on orbital shaker for 2 hours. The analysis was performed on a 1450 Microbeta Trilux (Wallac). Percent above background represents the percentage amount of counts per minute above the negative controls. Percents greater than or equal to 30% above background are considered positive.

PDB12 Cell Inhibition

This assay will demonstrates if the compounds disclosed herein have efficacy in inhibiting protein production by PDB12 pancreatic ductal cells and are, therefore, useful in the therapeutic treatment of disorders which involve protein secretion by the pancreas, including diabetes, and the like.

PDB12 pancreatic ductal cells are plated on fibronectin coated 96 well plates at $1.5×10^3$ cells per well in 100 µL/180 µL of growth media. 100 µL of growth media with the compound test sample or negative control lacking the compound is then added to well, for a final volume of 200 µL. Controls contain growth medium containing a protein shown to be inactive in this assay. Cells are incubated for 4 days at 37° C. 20 µL of Alamar Blue Dye (AB) is then added to each well and the fluorescent reading is measured at 4 hours post addition of AB, on a microtiter plate reader at 530 nm excitation and 590 nm emission. The standard employed is cells without Bovine Pituitary Extract (BPE) and with various concentrations of BPE. Buffer or CM controls from unknowns are run 2 times on each 96 well plate.

These assays allow one to calculate a percent decrease in protein production by comparing the Alamar Blue Dye calculated protein concentration produced by the compound-treated cells with the Alamar Blue Dye calculated protein concentration produced by the negative control cells. A percent decrease in protein production of greater than or equal to 25% as compared to the negative control cells is considered positive.

Stimulation of Adult Heart Hypertrophy

This assay is designed to measure the ability of the various compounds disclosed herein to stimulate hypertrophy of adult heart. A positive test in this assay indicates that the compound would be expected to be useful for the therapeutic treatment of various cardiac insufficiency disorders.

Ventricular myocytes freshly isolated from adult (250 g) Sprague Dawley rats are plated at 2000 cell/well in 180 µl volume. Cells are isolated and plated on day 1, the compound-containing test samples or growth medium only (negative control) (20 µl volume) is added on day 2 and the cells are then fixed and stained on day 5. After staining, cell size is visualized wherein cells showing no growth enhancement as compared to control cells are given a value of 0.0, cells showing small to moderate growth enhancement as compared to control cells are given a value of 1.0 and cells showing large growth enhancement as compared to control cells are given a value of 2.0. Any degree of growth enhancement as compared to the negative control cells is considered positive for the assay.

PDB12 Cell Proliferation

This assay demonstrates whether the various compounds disclosed herein have efficacy in inducing proliferation of PDB12 pancreatic ductal cells and are, therefore, useful in the therapeutic treatment of disorders which involve protein secretion by the pancreas, including diabetes, and the like.

PDB12 pancreatic ductal cells are plated on fibronectin coated 96 well plates at $1.5×10^3$ cells per well in 100 µL/180 µL of growth media. 100 µL of growth media with the compound test sample or negative control lacking the compound tested is then added to well, for a final volume of 200 µL. Controls contain growth medium containing a protein shown to be inactive in this assay. Cells are incubated for 4 days at 37° C. 20 µL of Alamar Blue Dye (AB) is then added to each well and the fluorescent reading is measured at 4 hours post addition of AB, on a microtiter plate reader at 530 nm excitation and 590 nm emission. The standard employed is cells without Bovine Pituitary Extract (BPE) and with various concentrations of BPE. Buffer or growth medium only controls from unknowns are run 2 times on each 96 well plate.

Percent increase in protein production is calculated by comparing the Alamar Blue Dye calculated protein concentration produced by the test compound-treated cells with the Alamar Blue Dye calculated protein concentration produced by the negative control cells. A percent increase in protein production of greater than or equal to 25% as compared to the negative control cells is considered positive.

Enhancement of Heart Neonatal Hypertrophy

This assay is designed to measure the ability of the compounds disclosed herein to stimulate hypertrophy of neonatal heart. Testing positive in this assay indicates the compounds to be useful for the therapeutic treatment of various cardiac insufficiency disorders.

Cardiac myocytes from 1-day old Harlan Sprague Dawley rats are obtained. Cells (180 µl at $7.5 \times 10^4$/ml, serum <0.1%, freshly isolated) are added on day 1 to 96-well plates previously coated with DMEM/F12+4% FCS. Test samples containing the test compound or growth medium only (negative control) (20 µl/well) are added directly to the wells on day 1. PGF (20 µl/well) is then added on day 2 at final concentration of $10^{-6}$ M. The cells are then stained on day 4 and visually scored on day 5, wherein cells showing no increase in size as compared to negative controls are scored 0.0, cells showing a small to moderate increase in size as compared to negative controls are scored 1.0 and cells showing a large increase in size as compared to negative controls are scored 2.0. A positive result in the assay is a score of 1.0 or greater.

Stimulatory Activity in Mixed Lymphocyte Reaction (MLR) Assay

This assay is used to determine if the compounds disclosed herein are active as a stimulator of the proliferation of stimulated T-lymphocytes. Compounds which stimulate proliferation of lymphocytes are useful therapeutically where enhancement of an immune response is beneficial. A therapeutic agent may take the form of antagonists of the compounds of the invention, for example, murine-human chimeric, humanized or human antibodies against the compound.

The basic protocol for this assay is described in Current Protocols in Immunology, unit 3.12; edited by J E Coligan, A M Kruisbeek, D H Marglies, E M Shevach, W Strober, National Institutes of Health, Published by John Wiley & Sons, Inc.

More specifically, in one assay variant, peripheral blood mononuclear cells (PBMC) are isolated from mammalian individuals, for example a human volunteer, by leukopheresis (one donor will supply stimulator PBMCs, the other donor will supply responder PBMCs). If desired, the cells are frozen in fetal bovine serum and DMSO after isolation. Frozen cells may be thawed overnight in assay media (37° C., 5% $CO_2$) and then washed and resuspended to $3 \times 10^6$ cells/ml of assay media (RPMI; 10% fetal bovine serum, 1% penicillin/streptomycin, 1% glutamine, 1% HEPES, 1% non-essential amino acids, 1% pyruvate). The stimulator PBMCs are prepared by irradiating the cells (about 3000 Rads).

The assay is prepared by plating in triplicate wells a mixture of:
100:1 of test sample diluted to 1% or to 0.1%,
50:1 of irradiated stimulator cells, and
50:1 of responder PBMC cells.

100 microliters of cell culture media or 100 microliter of CD4-IgG is used as the control. The wells are then incubated at 37° C., 5% $CO_2$ for 4 days. On day 5, each well is pulsed with tritiated thymidine (1.0 mC/well; Amersham). After 6 hours the cells are washed 3 times and then the uptake of the label is evaluated.

In another variant of this assay, PBMCs are isolated from the spleens of Balb/c mice and C57B6 mice. The cells are teased from freshly harvested spleens in assay media (RPMI; 10% fetal bovine serum, 1% penicillin/streptomycin, 1% glutamine, 1% HEPES, 1% non-essential amino acids, 1% pyruvate) and the PBMCs are isolated by overlaying these cells over Lympholyte M (Organon Teknika), centrifuging at 2000 rpm for 20 minutes, collecting and washing the mononuclear cell layer in assay media and resuspending the cells to $1 \times 10^7$ cells/ml of assay media. The assay is then conducted as described above.

Positive increases over control are considered positive with increases of greater than or equal to 180% being preferred. However, any value greater than control indicates a stimulatory effect for the test protein.

Pericyte c-Fos Induction

This assay shows the ability of the compounds disclosed herein of the invention act to induce the expression of c-fos in pericyte cells and, therefore, their use not only as diagnostic markers for particular types of pericyte-associated tumors but also for giving rise to antagonists which would be expected to be useful for the therapeutic treatment of pericyte-associated tumors. Specifically, on day 1, pericytes are received from VEC Technologies and all but 5 ml of media is removed from flask. On day 2, the pericytes are trypsinized, washed, spun and then plated onto 96 well plates. On day 7, the media is removed and the pericytes are treated with 100 of test compound samples and controls (positive control=DME+5% serum +/-PDGF at 500 ng/ml; negative control=protein 32). Replicates are averaged and SD/CV are determined. Fold increase over Protein 32 (buffer control) value indicated by chemiluminescence units (RLU) luminometer reading verses frequency is plotted on a histogram. Two-fold above Protein 32 value is considered positive for the assay. ASY Matrix: Growth media=low glucose DMEM=20% FBS+1× pen/strep+1× fungizone. Assay Media=low glucose DMEM+5% FBS.

Ability of the Compounds of the Invention to Stimulate the Release of Proteoglycans from Cartilage The ability of the compounds disclosed herein to stimulate the release of proteoglycans from cartilage tissue can be tested as follows.

The metacarphophalangeal joint of 4-6 month old pigs is aseptically dissected, and articular cartilage was removed by free hand slicing being careful to avoid the underlying bone. The cartilage was minced and cultured in bulk for 24 hours in a humidified atmosphere of 95% air, 5% $CO_2$ in serum free (SF) media (DME/F12 1:1) with 0.1% BSA and 100 U/ml penicillin and 100 µg/ml streptomycin. After washing three times, approximately 100 mg of articular cartilage is aliquoted into micronics tubes and incubated for an additional 24 hours in the above SF media. The compound is then added at 1% either alone or in combination with 18 ng/ml interleukin-1 alpha, a known stimulator of proteoglycan release from cartilage tissue. The supernatant is then harvested and assayed for the amount of proteoglycans using the 1,9-dimethyl-methylene blue (DMB) calorimetric assay (Farndale and Buttle, Biochem. Biophys. Acta 883:173-177 (1985)). A positive result in this assay indicates that the test compound will find use, for example, in the treatment of sports-related joint problems, articular cartilage defects, osteoarthritis or rheumatoid arthritis.

Skin Vascular Permeability Assay

This assay is used to test whether compounds of the invention stimulate an immune response and induce inflammation by inducing mononuclear cell, eosinophil and PMN infiltration at the site of injection of the animal. Compounds which stimulate an immune response are useful therapeutically where stimulation of an immune response is beneficial. This skin vascular permeability assay is conducted as follows. Hairless guinea pigs weighing 350 grams or more are anesthetized with ketamine (75-80 mg/Kg) and 5 mg/Kg xylazine intramuscularly (IM). A sample of purified compound of the invention or a conditioned media test sample is injected intradermally onto the backs of the test animals with 100 µl per injection site. It is possible to have about 10-30, preferably about 16-24, injection sites per animal. One µl of Evans blue dye (1% in physiological buffered saline) is injected intracardially. Blemishes at the injection sites are then measured (mm diameter) at 1 hr and 6 hr post injection. Animals were sacrificed at 6 hrs after injection. Each skin injection site is biopsied and fixed in formalin. The skins are then prepared for histopathologic evaluation. Each site is evaluated for inflammatory cell infiltration into the skin. Sites with visible inflammatory cell inflammation are scored as positive. Inflammatory cells may be neutrophilic, eosinophilic, monocytic or lymphocytic. At least a minimal perivascular infiltrate at the injection site is scored as positive, no infiltrate at the site of injection is scored as negative.

Enhancement of Heart Neonatal Hypertrophy Induced by F2a

This assay is designed to measure the ability of compounds disclosed herein to stimulate hypertrophy of neonatal heart, a positive test indicating usefulness for the therapeutic treatment of various cardiac insufficiency disorders.

Cardiac myocytes from 1-day old Harlan Sprague Dawley rats were obtained. Cells (180 µl at $7.5 \times 10^4$/ml, serum <0.1%, freshly isolated) are added on day 1 to 96-well plates previously coated with DMEM/F12+4% FCS. Test samples containing the test compound (20 µl/well) are added directly to the wells on day 1. PGF (20 µl/well) is then added on day 2 at a final concentration of $10^{-6}$ M. The cells are then stain on day 4 and visually scored on day 5. Visual scores are based on cell size, wherein cells showing no increase in size as compared to negative controls are scored 0.0, cells showing a small to moderate increase in size as compared to negative controls are scored 1.0 and cells showing a large increase in size as compared to negative controls are scored 2.0. A score of 1.0 or greater is considered positive.

No PBS is included, since calcium concentration is critical for assay response. Plates are coated with DMEM/F12 plus 4% FCS (200 µl/well). Assay media included: DMEM/F12 (with 2.44 gm bicarbonate), µg/ml transferrin, 1 µg/ml insulin, 1 µg/ml aprotinin, 2 mmol/L glutamine, 100 U/ml penicillin G, 100 µg/ml streptomycin. Protein buffer containing mannitol (4%) gave a positive signal (score 3.5) at 1/10 (0.4%) and 1/100 (0.04%), but not at 1/1000 (0.004%). Therefore the test sample buffer containing mannitol is not run.

Inhibitory Activity in Mixed Lymphocyte Reaction (MLR) Assay

This example shows that one or more of the compound of the invention are active as inhibitors of the proliferation of stimulated T-lymphocytes. Compounds which inhibit proliferation of lymphocytes are useful therapeutically where suppression of an immune response is beneficial.

The basic protocol for this assay is described in Current Protocols in Immunology, unit 3.12; edited by J E Coligan, A M Kruisbeek, D H Marglies, E M Shevach, W Strober, National Institutes of Health, Published by John Wiley & Sons, Inc.

More specifically, in one assay variant, peripheral blood mononuclear cells (PBMC) are isolated from mammalian individuals, for example a human volunteer, by leukopheresis (one donor will supply stimulator PBMCs, the other donor will supply responder PBMCs). If desired, the cells are frozen in fetal bovine serum and DMSO after isolation. Frozen cells may be thawed overnight in assay media (37° C., 5% $CO_2$) and then washed and resuspended to $3 \times 10^6$ cells/ml of assay media (RPMI; 10% fetal bovine serum, 1% penicillin/streptomycin, 1% glutamine, 1% HEPES, 1% non-essential amino acids, 1% pyruvate). The stimulator PBMCs are prepared by irradiating the cells (about 3000 Rads).

The assay is prepared by plating in triplicate wells a mixture of:
100:1 of test sample diluted to 1% or to 0.1%,
50:1 of irradiated stimulator cells, and
50:1 of responder PBMC cells.

100 microliters of cell culture media or 100 microliter of CD4-IgG is used as the control. The wells are then incubated at 37° C., 5% $CO_2$ for 4 days. On day 5, each well is pulsed with tritiated thymidine (1.0 mC/well; Amersham). After 6 hours the cells are washed 3 times and then the uptake of the label is evaluated.

In another variant of this assay, PBMCs are isolated from the spleens of Balb/c mice and C57B6 mice. The cells are teased from freshly harvested spleens in assay media (RPMI; 10% fetal bovine serum, 1% penicillin/streptomycin, 1% glutamine, 1% HEPES, 1% non-essential amino acids, 1% pyruvate) and the PBMCs are isolated by overlaying these cells over Lympholyte M (Organon Teknika), centrifuging at 2000 rpm for 20 minutes, collecting and washing the mononuclear cell layer in assay media and resuspending the cells to $1 \times 10^7$ cells/ml of assay media. The assay is then conducted as described above.

Any decreases below control is considered to be a positive result for an inhibitory compound, with decreases of less than or equal to 80% being preferred. However, any value less than control indicates an inhibitory effect for the test protein.

Induction of Endothelial Cell Apoptosis (ELISA)

The ability of the compounds disclosed herein to induce apoptosis in endothelial cells can be tested in human venous umbilical vein endothelial cells (HUVEC, Cell Systems) using a 96-well format, in 0% serum media supplemented with 100 ng/ml VEGF, 0.1% BSA, 1× pen/strep.

A positive result in this assay indicates the usefulness of the compound for therapeutically treating any of a variety of conditions associated with undesired endothelial cell growth including, for example, the inhibition of tumor growth. Coating of 96 well plates can be prepared by allowing gelatinization to occur for >30 minutes with 100 µl of 0.2% gelatin in PBS solution. The gelatin mix is aspirated thoroughly before plating HUVEC cells at a final concentration of $2 \times 10^4$ cells/ml in 10% serum containing medium—100 µl volume per well. The cells were grown for 24 hours before adding test samples containing the compound of interest.

To all wells, 100 µl of 0% serum media (Cell Systems) complemented with 100 ng/ml VEGF, 0.1% BSA, 1× pen/strep is added. Test samples containing the test compound were added in triplicate at dilutions of 1%, 0.33% and 0.11%. Wells without cells were used as a blank and wells with cells only are used as a negative control. As a positive control, 1:3 serial dilutions of 50 µl of a 3× stock of staurosporine are used. The cells were incubated for 24 to 35 hours prior to ELISA.

ELISA is used to determine levels of apoptosis preparing solutions according to the Boehringer Manual [Boehringer, Cell Death Detection ELISA plus, Cat No. 1 920 685]. Sample preparations: 96 well plates are spun down at 1 krpm for 10 minutes (200 g); the supernatant is removed by fast inversion, placing the plate upside down on a paper towel to remove residual liquid. To each well, 200 µl of 1× Lysis buffer is added and incubation allowed at room temperature for 30 minutes without shaking. The plates were spun down for 10 minutes at 1 krpm, and 20 µl of the lysate (cytoplasmic fraction) is transferred into streptavidin coated MTP. 80 µl of immunoreagent mix was added to the 20 µl lystate in each well. The MTP was covered with adhesive foil and incubated at room temperature for 2 hours by placing it on an orbital shaker (200 rpm). After two hours, the supernatant was removed by suction and the wells rinsed three times with 250 µl of 1× incubation buffer per well (removed by suction). Substrate solution was added (100 µl) into each well and incubated on an orbital shaker at room temperature at 250 rpm until color development was sufficient for a photometric analysis (approx. after 10-20 minutes). A 96 well reader was used to read the plates at 405 nm, reference wavelength, 492 nm. The levels obtained for PIN 32 (control buffer) was set to 100%. Samples with levels >130% were considered positive for induction of apoptosis.

Human Venous Endothelial Cell Calcium Flux Assay

This assay is designed to determine whether compounds of the present invention show the ability to stimulate calcium flux in human umbilical vein endothelial cells (HUVEC, Cell Systems). Calcium influx is a well documented response upon binding of certain ligands to their receptors. A test compound that results in a positive response in the present calcium influx assay can be said to bind to a specific receptor and activate a biological signaling pathway in human endothelial cells. This could ultimately lead, for example, to endothelial cell division, inhibition of endothelial cell proliferation, endothelial tube formation, cell migration, apoptosis, etc.

Human venous umbilical vein endothelial cells (HUVEC, Cell Systems) in growth media (50:50 without glycine, 1% glutamine, 10 mM Hepes, 10% FBS, 10 ng/ml bFGF), are plated on 96-well microtiter ViewPlates-96 (Packard Instrument Company Part #6005182) microtiter plates at a cell density of $2\times10^4$ cells/well. The day after plating, the cells are washed three times with buffer (HBSS plus 10 mM Hepes), leaving 100 µl/well. Then 100 µl/well of 8 Fluo-3 (2× is added. The cells are incubated for 1.5 hours at 37° C./5% $CO_2$. After incubation, the cells are then washed 3× with buffer (described above) leaving 100 µl/well. Test samples of the compound are prepared on different 96-well plates at 5× concentration in buffer. The positive control corresponded to 50 µM ionomycin (5×); the negative control corresponded to Protein 32. Cell plate and sample plates are run on a FLIPR (Molecular Devices) machine. The FLIPR machine added 25 µl of test sample to the cells, and readings are taken every second for one minute, then every 3 seconds for the next three minutes.

The fluorescence change from baseline to the maximum rise of the curve (Δ change) is calculated, and replicates averaged. The rate of fluorescence increase is monitored, and only those samples which had a Δ change greater than 1000 and a rise within 60 seconds, are considered positive.

Fibroblast (BHK-21) Proliferation

This assay will show if the compounds of the invention act to induce proliferation of mammalian fibroblast cells in culture and, therefore, function is useful growth factors in mammalian systems.

The assay is performed is follows. BHK-21 fibroblast cells plated in standard growth medium at 2500 cells/well in a total volume of 100 µl. The compound, beta-FGF (positive control) or nothing (negative control) are then added to the wells in the presence of 1 µg/ml of heparin for a total final volume of 200 µl. The cells are then incubated at 37° C. for 6 to 7 days. After incubation, the media is removed, the cells are washed with PBS and then an acid phosphatase substrate reaction mixture (100 µl/well) is added. The cells are then incubated at 37° C. for 2 hours. 10 µL per well of 1N NaOH is then added to stop the acid phosphatase reaction. The plates are then read at OD 405 nm. A positive in the assay is acid phosphatase activity which is at least 50% above the negative control.

Inhibition of Heart Adult Hypertrophy

This assay is designed to measure the inhibition of heart adult hypertrophy. Compounds testing positive in this assay may find use in the therapeutic treatment of cardiac disorders associated with cardiac hypertrophy.

Ventricular myocytes are freshly isolated from adult (250 g) Harlan Sprague Dawley rats and the cells are plated at 2000/well in 180 µl volume. On day two, test samples (20 µL) containing the test compound are added. On day five, the cells are fixed and then stained. An increase in ANP message can also be measured by PCR from cells after a few hours. Results are based on a visual score of cell size: 0=no inhibition, −1=small inhibition, −2=large inhibition. A score of less than 0 is considered positive. Activity reference corresponds to phenylephrine (PE) at 0.1 mM, is a positive control. Assay media included: M199 (modified)-glutamine free, $NaHCO_3$, phenol red, supplemented with 100 nM insulin, 0.2% BSA, 5 mM cretine, 2 mM L-carnitine, 5 mM taurine, 100 U/ml penicillin G, 100 µg/ml streptomycin (CCT medium). Only inner 60 wells are used in 96 well plates. Of these, 6 wells are reserved for negative and positive (PE) controls.

Induction of c-Fos in Endothelial Cells

This assay is designed to determine whether compounds of the invention show the ability to induce c-fos in endothelial cells. Compounds testing positive in this assay would be expected to be useful for the therapeutic treatment of conditions or disorders where angiogenesis would be beneficial including, for example, wound healing, and the like (is would agonists of these compounds). Antagonists of the compounds testing positive in this assay would be expected to be useful for the therapeutic treatment of cancerous tumors.

Human venous umbilical vein endothelial cells (HUVEC, Cell Systems) in growth media (50% Ham's F12 w/o GHT: low glucose, and 50% DMEM without glycine: with $NaHCO_2$, 1% glutamine, 10 mM HEPES, 10% FBS, 10 ng/ml bFGF) are plated on 96-well microtiter plates at a cell density of $1\times10^4$ cells/well. The day after plating, the cells are starved by removing the growth media and treating the cells with 100 µl/well test samples and controls (positive control=growth media; negative control=Protein 32 buffer=10 mM HEPES, 140 mM NaCl, 4% (w/v) mannitol, pH 6.8). The cells are incubated for 30 minutes at 37° C., in 5% $CO_2$. The samples are removed, and the first part of the bDNA kit protocol (Chiron Diagnostics, cat. #6005-037) is followed, where each capitalized reagent/buffer listed below is available from the kit.

Briefly, the amounts of the TM Lysis Buffer and Probes needed for the tests are calculated based on information provided by the manufacturer. The appropriate amounts of thawed Probes are added to the TM Lysis Buffer. The Capture Hybridization Buffer is warmed to room temperature. The bDNA strips are set up in the metal strip holders, and 100 µl of Capture Hybridization Buffer is added to each b-DNA well needed, followed by incubation for at least 30 minutes. The test plates with the cells are removed from the incubator, and the media is gently removed using the vacuum manifold. 100 µl of Lysis Hybridization Buffer with Probes are quickly pipetted into each well of the microtiter plates. The plates are then incubated at 55° C. for 15 minutes. Upon removal from the incubator, the plates are placed on the vortex mixer with the microtiter adapter head and vortexed on the #2 setting for one minute. 80 µl of the lysate is removed and added to the bDNA wells containing the Capture Hybridization Buffer, and pipetted up and down to mix. The plates are incubated at 53° C. for at least 16 hours.

On the next day, the second part of the bDNA kit protocol is followed. Specifically, the plates are removed from the incubator and placed on the bench to cool for 10 minutes. The volumes of additions needed are calculated based upon information provided by the manufacturer. An Amplifier Working Solution is prepared by making a 1:100 dilution of the Amplifier Concentrate (20 fm/µl) in AL Hybridization Buffer. The hybridization mixture is removed from the plates and washed twice with Wash A. 50 µl of Amplifier Working Solution is added to each well and the wells are incubated at 53° C. for 30 minutes. The plates are then removed from the incubator and allowed to cool for 10 minutes. The Label Probe Working Solution is prepared by making a 1:100 dilution of Label Concentrate (40 pmoles/µl) in AL Hybridization Buffer. After the 10-minute cool-down period, the amplifier hybridization mixture is removed and the plates are washed twice with Wash A. 50 µl of Label Probe Working Solution is added to each well and the wells are incubated at 53° C. for 15 minutes. After cooling for 10 minutes, the Substrate is warmed to room temperature. Upon addition of 3 µl of Substrate Enhancer to each ml of Substrate needed for the assay, the plates are allowed to cool for 10 minutes, the label hybridization mixture is removed, and the plates are washed twice with Wash A and three times with Wash D. 50 µl of the Substrate Solution with Enhancer is added to each well. The plates are incubated for 30 minutes at 37° C. and RLU is read in an appropriate luminometer.

The replicates are averaged and the coefficient of variation is determined. The measure of activity of the fold increase over the negative control (Protein 32/HEPES buffer described above) value is indicated by chemiluminescence units (RLU). The results are considered positive if the compound exhibits at least a two-fold value over the negative buffer control. Negative control=1.00 RLU at 1.00% dilution. Positive control=8.39 RLU at 1.00% dilution.

Guinea Pig Vascular Leak

This assay is designed to determine whether the compounds of the present invention show the ability to induce vascular permeability. Compounds testing positive in this assay are expected to be useful for the therapeutic treatment of conditions which would benefit from enhanced vascular permeability including, for example, conditions which may benefit from enhanced local immune system cell infiltration.

Hairless guinea pigs weighing 350 grams or more are anesthetized with Ketamine (75-80 mg/kg) and 5 mg/kg Xylazine intramuscularly. Test samples containing the tested compound or a physiological buffer without the test compound are injected into skin on the back of the test animals with 100 µl per injection site intradermally. There are approximately 16-24 injection sites per animal. One ml of Evans blue dye (1% in PBS) is then injected intracardially. Skin vascular permeability responses to the compounds (i.e., blemishes at the injection sites of injection) are visually scored by measuring the diameter (in mm) of blue-colored leaks from the site of injection at 1 and 6 hours post administration of the test materials. The mm diameter of blueness at the site of injection is observed and recorded is well is the severity of the vascular leakage. Blemishes of at least 5 mm in diameter are considered positive for the assay when testing purified proteins, being indicative of the ability to induce vascular leakage or permeability. A response greater than 7 mm diameter is considered positive for conditioned media samples. Human VEGF at 0.1 µg/100 µl is used is a positive control, inducing a response of 15-23 diameter.

Detection of Endothelial Cell Apoptosis (FACS)

The ability of the compounds disclosed herein to induce apoptosis in endothelial cells is tested in human venous umbilical vein endothelial cells (HUVEC, Cell Systems) in gelatinized T175 flasks using HUVEC cells below passage 10. Compounds testing positive in this assay are expected to be useful for therapeutically treating conditions where apoptosis of endothelial cells would be beneficial including, for example, the therapeutic treatment of tumors.

On day one, the cells are split [420,000 cells per gelatinized 6 cm dishes ($11 \times 10^3$ cells/cm$^2$ Falcon, Primaria)] and grown in media containing serum (CS-C, Cell System) overnight or for 16 hours to 24 hours.

On day 2, the cells are washed 1× with 5 ml PBS; 3 ml of 0% serum medium is added with VEGF (100 ng/ml); and 30 µl of the PRO test compound (final dilution 1%) or 0% serum medium (negative control) is added. The mixtures are incubated for 48 hours before harvesting.

The cells are then harvested for FACS analysis. The medium is aspirated and the cells washed once with PBS. 5 ml of 1× trypsin is added to the cells in a T-175 flask, and the cells are allowed to stand until they are released from the plate (about 5-10 minutes). Trypsinization is stopped by adding 5 ml of growth media. The cells are spun at 1000 rpm for 5 minutes at 4° C. The media is aspirated and the cells are resuspended in 10 ml of 10% serum complemented medium (Cell Systems), 5 µl of Annexin-FITC (BioVison) added and chilled tubes are submitted for FACS. A positive result is determined to be enhanced apoptosis in the compound treated samples is compared to the negative control.

Induction of c-Fos in Cortical Neurons

This assay is designed to determine whether the compounds tested show the ability to induce c-fos in cortical neurons. Compounds testing positive in this assay would be expected to be useful for the therapeutic treatment of nervous system disorders and injuries where neuronal proliferation would be beneficial.

Cortical neurons are dissociated and plated in growth medium at 10,000 cells per well in 96 well plates. After approximately 2 cellular divisions, the cells are treated for 30 minutes with the compound or nothing (negative control). The cells are then fixed for 5 minutes with cold methanol and stained with an antibody directed against phosphorylated CREB. mRNA levels are then calculated using chemiluminescence. A positive in the assay is any factor that results in at least a 2-fold increase in c-fos message is compared to the negative controls.

Stimulation of Endothelial Tube Formation

This assay is designed to determine whether the compounds of the invention show the ability to promote endothelial vacuole and lumen formation in the absence of exogenous growth factors. Compounds testing positive in this assay would be expected to be useful for the therapeutic treatment of disorders where endothelial vacuole and/or lumen formation would be beneficial including, for example, where the stimulation of pinocytosis, ion pumping, vascular permeability and/or junctional formation would be beneficial.

HUVEC cells (passage <8 from primary) are mixed with type I rat tail collagen (final concentration 2.6 mg/ml) at a density of $6 \times 10^5$ cells per ml and plated at 50 µl per well of M199 culture media supplement with 1% FBS and 1 µM 6-FAM-FITC dye to stain the vacuoles while they are forming and in the presence of the test compound. The cells are then incubated at 37° C./5% $CO_2$ for 48 hours, fixed with 3.7% formalin room temperature for 10 minutes, washed 5 times with M199 medium and then stained with Rh-Phalloidin at 4° C. overnight followed by nuclear staining with 4 µM DAPI. A positive result in the assay is when vacuoles are present in greater than 50% of the cells.

Detection of Compounds of the Invention that Affect Glucose and/or FFA Uptake in Skeletal Muscle This assay is designed to determine whether compounds of the invention show the ability to affect glucose or FFA uptake by skeletal muscle cells. Compounds testing positive in this assay would be expected to be useful for the therapeutic treatment of disorders where either the stimulation or inhibition of glucose uptake by skeletal muscle would be beneficial including, for example, diabetes or hyper- or hypo-insulinemia.

In a 96 well format, a compound to be assayed is added to primary rat differentiated skeletal muscle, and allowed to incubate overnight. Then fresh media with the compound and +/− insulin are added to the wells. The sample media is then monitored to determine glucose and FFA uptake by the skeletal muscle cells. The insulin will stimulate glucose and FFA uptake by the skeletal muscle, and insulin in media without the compound is used is a positive control, and a limit for scoring. As the compound being tested may either stimulate or inhibit glucose and FFA uptake, results are scored is positive in the assay if greater than 1.5 times or less than 0.5 times the insulin control.

Rod Photoreceptor Cell Survival Assay

This assay tests the ability of the compounds of this invention act to enhance the survival/proliferation of rod photoreceptor cells and, therefore, are useful for the therapeutic treatment of retinal disorders or injuries including, for example, treating sight loss in mammals due to retinitis pigmentosum, AMD, etc.

Sprague Dawley rat pups (postnatal day 7, mixed population: glia and netinal neural cell types) are killed by decapitation following $CO_2$ anesthesia and the eyes removed under sterile conditions. The neural retina is dissected away from the pigment epithelium and other ocular tissue and then dissociated into a single cell suspension using 0.25% trypsin in $Ca^{2+}$, $Mg^{2+}$-free PBS. The retinas are incubated at 37° C. in this solution for 7-10 minutes after which the trypsin is inactivated by adding 1 ml soybean trypsin inhibitor. The cells are plated at a density of approximately 10,000 cells/ml into 96 well plates in DMEM/F12 supplemented with $N_2$. Cells for all experiments are grown at 37° C. in a water saturated atmosphere of 5% $CO_2$. After 7-10 days in culture, the cells are stained using calcein AM or CellTracker Green CMFDA and then fixed using 4% paraformaldehyde. Rho 4D2 (ascities or IgG 1:100) monoclonal antibody directed towards the visual pigment rhodopsin is used to detect rod photoreceptor cells by indirect immunofluorescence. The results are calculated is % survival: total number of calcein-rhodopsin positive cells at 7-10 days in culture, divided by the total number of rhodopsin positive cells at time 7-10 days in culture. The total cells (fluorescent) are quantified at 20× objective magnification using a CCD camera and NIH image software for Macintosh. Fields in the well are chosen at random.

In Vitro Antitumor Assay

The antiproliferative activity of the compounds disclosed herein can be determined in the investigational, disease-oriented in vitro anti-cancer drug discovery assay of the National Cancer Institute (NCI), using a sulforhodamine B (SRB) dye binding assay essentially is described by Skehan et al., J. Natl. Cancer Inst. 82:1107-1112 (1990). The 60 tumor cell lines employed in this study ("the NCI panel"), as well as conditions for their maintenance and culture in vitro, have been described by Monks et al., J. Natl. Cancer Inst. 83:757-766 (1991). The purpose of this screen is to initially evaluate the cytotoxic and/or cytostatic activity of the test compounds against different types of tumors (Monks et al., supra; Boyd, Cancer: Princ. Pract. Oncol. Update 3(10):1-12 [1989]).

Cells from approximately 60 human tumor cell lines are harvested with trypsin/EDTA (Gibco), washed once, resuspended in IMEM and their viability is determined. The cell suspensions are added by pipet (100 µL volume) into separate 96-well microtiter plates. The cell density for the 6-day incubation is less than for the 2-day incubation to prevent overgrowth. Inoculates are allowed a preincubation period of 24 hours at 37° C. for stabilization. Dilutions at twice the intended test concentration are added at time zero in 100 µL aliquots to the microtiter plate wells (1:2 dilution). Test compounds are evaluated at five half-log dilutions (1000 to 100,000-fold). Incubations took place for two days and six days in a 5% $CO_2$ atmosphere and 100% humidity.

After incubation, the medium is removed and the cells are fixed in 0.1 ml of 10% trichloroacetic acid at 40° C. The plates are rinsed five times with deionized water, dried, stained for 30 minutes with 0.1 ml of 0.4% sulforhodamine B dye (Sigma) dissolved in 1% acetic acid, rinsed four times with 1% acetic acid to remove unbound dye, dried, and the stain is extracted for five minutes with 0.1 ml of 10 mM Tris base [tris(hydroxymethyl)aminomethane], pH 10.5. The absorbance (OD) of sulforhodamine B at 492 nm is measured using a computer-interfaced, 96-well microtiter plate reader.

A test sample is considered positive if it shows at least 50% growth inhibitory effect at one or more concentrations.

Determination of Compounds of this Invention that Affect Glucose or FFA Uptake by Primary Rat Adipocytes This assay is designed to determine whether the compounds of this invention show the ability to affect glucose or FFA uptake by adipocyte cells. Compounds testing positive in this assay would be expected to be useful for the therapeutic treatment of disorders where either the stimulation or inhibition of glucose uptake by adipocytes would be beneficial including, for example, obesity, diabetes or hyper- or hypo-insulinemia.

In a 96 well format, compounds to be assayed are added to primary rat adipocytes, and allowed to incubate overnight. Samples are taken at 4 and 16 hours and assayed for glycerol, glucose and FFA uptake. After the hour incubation, insulin is added to the media and allowed to incubate for 4 hours. At this time, a sample is taken and glycerol, glucose and FFA uptake is measured. Media containing insulin without the compound is used as a positive reference control. As the compound being tested may either stimulate or inhibit glucose and FFA uptake, results are scored as positive in the assay if greater than 1.5 times or less than 0.5 times the insulin control.

Chondrocyte Re-Differentiation Assay

This assay shows whether the compounds of the invention act to induce redifferentiation of chondrocytes, and therefore are expected to be useful for the treatment of various bone and/or cartilage disorders such as, for example, sports injuries and arthritis. The assay is performed as follows. Porcine chondrocytes are isolated by overnight collagenase digestion of articular cartilage of metacarpophalangeal joints of 4-6 month old female pigs. The isolated cells are then seeded at 25,000 cells/cm$^2$ in Ham F-12 containing 10% FBS and 4 µg/ml gentamycin. The culture media is changed every third day and the cells are then seeded in 96 well plates at 5,000 cells/well in 100 µl of the same media without serum and 100 µl of the test compound, 5 nM staurosporin (positive control) or medium alone (negative control) is added to give a final volume of 200 µl/well. After 5 days of incubation at 37° C., a picture of each well is taken and the differentiation state of the chondrocytes is determined. A positive result in the assay occurs when the redifferentiation of the chondrocytes is determined to be more similar to the positive control than the negative control.

Fetal Hemoglobin Induction in an Erythroblastic Cell Line

This assay is useful for screening compounds for the ability to induce the switch from adult hemoglobin to fetal hemoglobin in an erythroblastic cell line. Compounds testing positive in this assay are expected to be useful for therapeutically treating various mammalian hemoglobin-associated disorders such as the various thalassemias. The assay is performed as follows. Erythroblastic cells are plated in standard growth medium at 1000 cells/well in a 96 well format. The tested compound is added to the growth medium at a concentration of 0.2% or 2% and the cells are incubated for 5 days at 37° C. As a positive control, cells are treated with 100 µM hemin and as a negative control, the cells are untreated. After 5 days, cell lysates are prepared and analyzed for the expression of gamma globin (a fetal marker). A positive in the assay is a gamma globin level at least 2-fold above the negative control.

Mouse Kidney Mesangial Cell Proliferation Assay

This assay shows whether compounds of the invention act to induce proliferation of mammalian kidney mesangial cells and therefore are useful for treating kidney disorders associated with decreased mesangial cell function such as Berger disease or other nephropathies associated with Schonlein-Henoch purpura, celiac disease, dermatitis herpetiformis or Crohn disease. The assay is performed as follows. On day one, mouse kidney mesangial cells are plated on a 96 well plate in growth media (3:1 mixture of Dulbecco's modified Eagle's medium and Ham's F12 medium, 95% fetal bovine serum, 5% supplemented with mM HEPES) and grown overnight. On day 2, the test compound is diluted at 2 concentrations (1% and 0.1%) in serum-free medium and added to the cells. Control samples are serum-free medium alone. On day 4, 20 µl of the Cell Titer 96 Aqueous one solution reagent (Progema) was added to each well and the colormetric reaction was allowed to proceed for 2 hours. The absorbance (OD) is then measured at 490 nm. A positive in the assay is an absorbance reading which is at least 15% above the control reading.

Proliferation of Rat Utricular Supporting Cells

This assay is used to determine if compounds of the invention act as potent mitogens for inner ear supporting cells which are auditory hair cell progenitors and, therefore, are useful for inducing the regeneration of auditory hair cells and treating hearing loss in mammals. The assay is performed as follows. Rat UEC-4 utricular epithelial cells are aliquoted into 96 well plates with a density of 3000 cells/well in 200 µl of serum-containing medium at 33° C. The cells are cultured overnight and are then switched to serum-free medium at 37° C. Various dilutions of the compounds (or nothing for a control) are then added to the cultures and the cells are incubated for 24 hours. After the 24 hour incubation, $^3$H-thymidine (1 µCi/well) is added and the cells are then cultured for an additional 24 hours. The cultures are then washed to remove unincorporated radiolabel, the cells harvested and Cpm per well determined. Cpm of at least 30% or greater in the test compound treated cultures as compared to the control cultures is considered a positive in the assay.

Chondrocyte Proliferation Assay

This assay is designed to determine whether compounds of the present invention show the ability to induce the proliferation and/or redifferentiation of chondrocytes in culture. Compounds testing positive in this assay would be expected to be useful for the therapeutic treatment of various bone and/or cartilage disorders such as, for example, sports injuries and arthritis.

Porcine chondrocytes are isolated by overnight collagenase digestion of articular cartilage of the metacarpophalangeal joint of 4-6 month old female pigs. The isolated cells are then seeded at 25,000 cells/cm$^2$ in Ham F-12 containing 10% FBS and 4 µg/ml gentamycin. The culture media is changed every third day and the cells are reseeded to 25,000 cells/cm$^2$ every five days. On day 12, the cells are seeded in 96 well plates at 5,000 cells/well in 100 µl of the same media without serum and 100 µl of either serum-free medium (negative control), staurosporin (final concentration of 5 nM; positive control) or the test compound are added to give a final volume of 200 µl/well. After 5 days at 37° C., 20 µl of Alamar blue is added to each well and the plates are incubated for an additional 3 hours at 37° C. The fluorescence is then measured in each well (Ex: 530 nm; Em: 590 nm). The fluorescence of a plate containing 200 µl of the serum-free medium is measured to obtain the background. A positive result in the assay is obtained when the fluorescence of the compound treated sample is more like that of the positive control than the negative control.

Inhibition of Heart Neonatal Hypertrophy Induced by LIF+ET-1

This assay is designed to determine whether the compounds of the present invention show the ability to inhibit neonatal heart hypertrophy induced by LIF and endothelin-1 (ET-1). A test compound that provides a positive response in the present assay would be useful for the therapeutic treatment of cardiac insufficiency diseases or disorders characterized or associated with an undesired hypertrophy of the cardiac muscle.

Cardiac myocytes from 1-day old Harlan Sprague Dawley rats (180 µl at 7.5×10$^4$/ml, serum <0.1, freshly isolated) are introduced on day 1 to 96-well plates previously coated with DMEM/F12+4% FCS. Test compound samples or growth medium alone (negative control) are then added directly to the wells on day 2 in 20 µl volume. LIF+ET-1 are then added to the wells on day 3. The cells are stained after an additional 2 days in culture and are then scored visually the next day. A positive in the assay occurs when the compound treated myocytes are visually smaller on the average or less numerous than the untreated myocytes.

SEQUENCE LISTING (199 sequences)

SEQ ID NO: 1 - DNA, 4195 bp, Escherichia coli
ctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcaagcggccgcaacccgggaaaagcttggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacccccttggcttcttatgcatgctcccctgctccgacccgggctcctcgcccgcccggacccacaggccaccctcaaccgtcctggccccggacccaaaccccacccctcactctgcttctccccgcaggagaattcaatcgcgaaagggcccaaagatctgccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggagctagcatcccgcccctaactccgccctgttccgcccattctccgccccatggctgactaattttttttatttatgcagaggccgaggccgcctcggcctctgagctattccagaagtagtgaggaggcttttttggaggcctaggcttttgcgtcgagaagcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 2 - DNA, 824 bp, Escherichia coli
gttaacgaattcccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaagatctgttaac

SEQ ID NO: 3 - DNA, 785 bp, Artificial Sequence
  artificial construct relating to Homo Sapiens immunoglobulin
gttaacgaattcccaccatgctgctgctggcgagatgtctgctgctagtcctcgtctcctcgctgctggtatgctcgggactggcgtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgaagatctgttaac

SEQ ID NO: 4 - DNA, 785 bp, Artificial Sequence
  artificial construct relating to Homo Sapiens immunoglobulin
gttaacgaattcccaccatggccttgacctttgctttactggtggccctcctggtgctcagctgcaagtcaagctgctctgtgggctgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgaagatctgttaac

SEQ ID NO: 5 - DNA, 767 bp, Artificial Sequence
  artificial construct relating to Homo Sapiens immunoglobulin
gttaacgaattcccaccatgctggctgccacagtcctgaccctggccctgctgggcaatgcccatgcctgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgaagatctgttaac

SEQ ID NO: 6 - DNA, 767 bp, Artificial Sequence
  artificial construct relating to Homo Sapiens immunoglobulin
gttaacgaattcccaccatgctgctgctggcgagatgtctgctgctagtcctcgtctcctcgctgctggtatgctcgggactggcgtgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgaagatctgttaac

SEQ ID NO: 7 - DNA, 767 bp, Artificial Sequence
  artificial construct relating to Homo Sapiens immunoglobulin
gttaacgaattcccaccatggccttgacctttgctttactggtggccctcctggtgctcagctgcaagtcaagctgctctgtgggctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgaagatctgttaac

SEQ ID NO: 8 - DNA, 749 bp, Artificial Sequence
  artificial construct relating to Homo Sapiens immunoglobulin
gttaacgaattcccaccatgctggctgccacagtcctgaccctggccctgctgggcaatgcccatgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgaagatctgttaac

SEQ ID NO: 9 - DNA, 1427 bp, Artificial Sequence
  artificial construct relating to Homo Sapiens immunoglobulin
gttaacgaattcccaccatgagctttccatgtaaatttgtagccagcttccttctgattttcaatgtttcttccaaaggtgcagtctccaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccggagctgcaactggaggagagctgtgcggaggcgcaggacggggagctggacgggtgcgtatccggtgacaccattgtaatgactagtggcggtccgcgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgaagatctgttaac

SEQ ID NO: 10 - DNA, 1430 bp, Artificial Sequence
  artificial construct relating to Homo Sapiens immunoglobulin
gttaacgaattcccaccatgaaccggggagtcccttttaggcacttgcttctggtgctgcaactggcgctcctcccagcagccactcagggaaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccggagctgcaactggaggagagctgtgcggaggcgcaggacggggagctggacgggtgcgtatccggtgacaccattgtaatgactagtggcggtccgcgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgaagatctgttaac

SEQ ID NO: 11 - DNA, 1430 bp, Artificial Sequence
  artificial construct relating to Homo Sapiens immunoglobulin
gttaacgaattcccaccatgctgctgctggcgagatgtctgctgctagtcctcgtctcctcgctgctggtatgctcgggactggcgtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccggagctgcaactggaggagagctgtgcggaggcgcaggacggggagctggacgggtgcgtatccggtgacaccattgtaatgactagtggcggtccgcgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgaagatctgttaac

SEQ ID NO: 12 - DNA, 1430 bp, Artificial Sequence
  artificial construct relating to Homo Sapiens immunoglobulin
gttaacgaattcccaccatggccttgacctttgctttactggtggccctcctggtgctcagctgcaagtcaagctgctctgtgggctgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccggagctgcaactggaggagagctgtgcggaggcgcaggacggggagctggacgggtgcgtatccggtgacaccattgtaatgactagtggcggtccgcgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgaagatctgttaac

SEQ ID NO: 13 - DNA, 1412 bp, Artificial Sequence
  artificial construct relating to Homo Sapiens immunoglobulin
gttaacgaattcccaccatgctggctgccacagtcctgaccctggccctgctgggcaatgcccatgcctgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccggagctgcaactggaggagagctgtgcggaggcgcaggacggggagctggacgggtgcgtatccggtgacaccattgtaatgactagtggcggtccgcgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgaagatctgttaac

SEQ ID NO: 14 - DNA, 1412 bp, Artificial Sequence
  artificial construct relating to Homo Sapiens immunoglobulin
gttaacgaattcccaccatgctgctgctggcgagatgtctgctgctagtcctcgtctcctcgctgctggtatgctcgggactggcgtgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccggagctgcaactggaggagagctgtgcggaggcgcaggacggggagctggacgggtgcgtatccggtgacaccattgtaatgactagtggcggtccgcgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgaagatctgttaac

SEQ ID NO: 15 - DNA, 1412 bp, Artificial Sequence
  artificial construct relating to Homo Sapiens immunoglobulin
gttaacgaattcccaccatggccttgacctttgctttactggtggccctcctggtgctcagctgcaagtcaagctgctctgtgggctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccggagctgcaactggaggagagctgtgcggaggcgcaggacggggagctggacgggtgcgtatccggtgacaccattgtaatgactagtggcggtccgcgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgaagatctgttaac

SEQ ID NO: 16 - DNA, 1394 bp, Artificial Sequence
  artificial construct relating to Homo Sapiens immunoglobulin
gttaacgaattcccaccatgctggctgccacagtcctgaccctggccctgctgggcaatgcccatgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccggagctgcaactggaggagagctgtgcggaggcgcaggacggggagctggacgggtgcgtatccggtgacaccattgtaatgactagtggcggtccgcgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgaagatctgttaac

SEQ ID NO: 17 - DNA, 1820 bp, Artificial Sequence
  artificial construct relating to Homo Sapiens immunoglobulin
gttaacgaattcccaccatgaaccggggagtcccttttaggcacttgcttctggtgctgcaactggcgctcctcccagcagccactcagggaaagaaagtggtgctgggcaaaaaaggggatacagtggaactgacctgtacagcttcccagaagaagagcatacaattccactggaaaaactccaaccagataaagattctgggaaatcagggctccttcttaactaaaggtccatccaagctgaatgatcgcgctgactcaagaagaagcctttgggaccaaggaaacttccccctgatcatcaagaatcttaagatagaagactcagatacttacatctgtgaagtggaggaccagaaggaggaggtgcaattgctagtgttcggattgactgccaactctgacacccacctgcttcaggggcagagcctgaccctgaccttggagagcccccctggtagtagcccctcagtgcaatgtaggagtccaaggggtaaaaacatacagggggggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagcttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccagggtgcgtatccggtgacaccattgtaatgactagtggcggtccgcgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgaagatctgttaac

SEQ ID NO: 18 - DNA, 1364 bp, Artificial Sequence
  artificial construct relating to Homo Sapiens immunoglobulin
gttaacgaattcccaccatggcttgggtgtggaccttgcttttcctgatggcagctgcccaaagtatccaagcacagatccagttggtccagtctggacctgagctgaagaagcctggagagacagtcaagatctcctgcaaggcttcaggatataccttcacacactatggaatgaactgggtgaagcaggctccaggaaagggtttaaagtggatgggctggataaacacctacactggagagccaacatatgctgatgacttcaaggaacactttgccttctctttggaaacctctgccagcactgtctttttgcagatcaacaacctcaaaaatgaggacacggccacatatttctgtgcaagagaacggggggatgctatggactactggggtcagggaacctccgtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacagggtgcgtatccggtgacaccattgtaatgactagtggcggtccgcgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgaagatctgttaac

SEQ ID NO: 19 - DNA, 737 bp, Artificial Sequence
  artificial construct relating to Homo Sapiens immunoglobulin
gttaacgaattcccaccatgaagtcacagacccaggtcttcgtatttctactgctctgtgtgtctggtgctcatgggagtattgtgatgacccagactcccaaattcctgcttgtatcagcaggagacagggttaccataacctgcacggccagtcagagtgtgagtaatgatgtagtttggtaccaacagaagccagggcagtctcctaaaatgctgatgtattctgcattcaatcgctacactggagtccctgatcgtttcactggcagaggatacgggacggatttcactttcaccatcagctctgtgcaggctgaagacctggcagtttatttctgtcagcaggattataactctcctcggacgttcggtggaggcaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagtgaagatctgttaac

SEQ ID NO: 20 - DNA, 1268 bp, Artificial Sequence
  artificial construct relating to Homo Sapiens immunoglobulin
gttaacgaattcccaccatgggcctctccaccgtgcctgacctgctgctgccgctggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtggggtgcgtatccggtgacaccattgtaatgactagtggcggtccgcgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgaagatctgttaac

SEQ ID NO: 21 - DNA, 1403 bp, Artificial Sequence
  artificial construct relating to Homo Sapiens immunoglobulin
gttaacgaattcccaccatggcgcccgtcgccgtctgggccgcgctggccgtcggactggagctctgggctgcggcgcacgccttgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacgggtgcgtatccggtgacaccattgtaatgactagtggcggtccgcgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgaagatctgttaac

SEQ ID NO: 22 - DNA, 2906 bp, Artificial Sequence
  artificial construct relating to Homo Sapiens immunoglobulin
gttaacgaattcccaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctggaattattttaggaccaggaagcagcacgctgtttattgaaagagtcacagaagaggatgaaggtgtctatcactgcaaagccaccaaccagaagggctctgtggaaagttcagcatacctcactgttcaaggaacctcggacaagtctaatctggaggggtgcgtatccggtgacaccattgtaatgactagtggcggtccgcgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgaagatctgttaac

SEQ ID NO: 23 - DNA, 2924 bp, Artificial Sequence
  artificial construct relating to Homo Sapiens immunoglobulin
gttaacgaattcccaccatgcagagcaaggtgctgctggccgtcgccctgtggctctgcgtggagacccgggccgcctctgtgggtttgcctagtgtttctcttgatctgcccaggctcagcatacaaaaagacatacttacaattaaggctaatacaactcttcaaattacttgcaggggacagagggacttggactggctttggcccaataatcagagtggcagtgagcaaagggtggaggtgactgagtgcagcgatggcctcttctgtaagacactcacaattccaaaagtgatcggaaatgacactggagcctacaagtgcttctaccgggaaactgacttggcctcggtcatttatgtctatgttcaagattacagatctccatttattgcttctgttagtgaccaacatggagtcgtgtacattactgagaacaaaaacaaaactgtggtgattccatgtctcgggtccatttcaaatctcaacgtgtcactttgtgcaagatacccagaaaagagatttgttcctgatggtaacagaatttcctgggacagcaagaagggctttactattcccagctacatgatcagctatgctggcatggtcttctgtgaagcaaaaattaatgatgaaagttaccagtctattatgtacatagttgtcgttgtagggtataggatttatgatgtggttctgagtccgtctcatggaattgaactatctgttggagaaaagcttgtcttaaattgtacagcaagaactgaactaaatgtggggattgacttcaactgggaatacccttcttcgaagcatcagcataagaaacttgtaaaccgagacctaaaaacccagtctgggagtgagatgaagaaatttttgagcaccttaactatagatggtgtaacccggagtgaccaaggattgtacacctgtgcagcatccagtgggctgatgaccaagaagaacagcacatttgtcagggtccatgaaaaaccttttgttgcttttggaagtggcatggaatctctggtggaagccacggtgggggagcgtgtcagaatccctgcgaagtaccttggttacccacccccagaaataaaatggtataaaaatggaataccccttgagtccaatcacacaattaaagcggggcatgtactgacgattatggaagtgagtgaaagagacacaggaaattacactgtcatccttaccaatcccatttcaaaggagaagcagagccatgtggtctctctggttgtgtatgtcccaccccagattggtgagaaatctctaatctctcctgtggattcctaccagtacggcaccactcaaacgctgacatgtacggtctatgccattcctcccccgcatcacatccactggtattggcagttggaggaagagtgcgccaacgagcccagccaagctgtctcagtgacaaacccatacccttgtgaagaatggagaagtgtggaggacttccagggaggaaataaaattgaagttaataaaaatcaatttgctctaattgaaggaaaaaacaaaactgtaagtacccttgttatccaagcggcaaatgtgtcagctttgtacaaatgtgaagcggtcaacaaagtcgggagaggagagagggtgatctccttccacgtgaccaggggtcctgaaattactttgcaacctgacatgcagcccactgagcaggagagcgtgtctttgtggtgcactgcagacagatctacgtttgagaacctcacatggtacaagcttggcccacagcctctgccaatccatgtgggagagttgcccacacctgtttgcaagaacttggatactctttggaaattgaatgccaccatgttctctaatagcacaaatgacattttgatcatggagcttaagaatgcatccttgcaggaccaaggagactatgtctgccttgctcaagacaggaagaccaagaaaagacattgcgtggtcaggcagctcacagtcctagagcgtgtggcacccacgatcacaggaaacctggagaatcagacgacaagtattggggaaagcatcgaagtctcatgcacggcatctgggaatccccctccacagatcatgtggtttaaagataatgagacccttgtagaagactcaggcattgtattgaaggatgggaaccggaacctcactatccgcagagtgaggaaggaggacgaaggcctctacacctgccaggcatgcagtgttcttggctgtgcaaaagtggaggcatttttcataatagaaggtgcccaggaaaagacgaacttggaagggtgcgtatccggtgacaccattgtaatgactagtggcggtccgcgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgaagatctgttaac

SEQ ID NO: 24 - DNA, 2957 bp, Artificial Sequence
  artificial construct relating to Homo Sapiens immunoglobulin
gttaacgaattcccaccatgcagcggggcgccgcgctgtgcctgcgactgtggctctgcctgggactcctggacggcctggtgagtggctactccatgacccccccgaccttgaacatcacggaggagtcacacgtcatcgacaccggtgacagcctgtccatctcctgcaggggacagcaccccctcgagtgggcttggccaggagctcaggaggcgccagccaccggagacaaggacagcgaggacacgggggtggtgcgagactgcgagggcacagacgccaggccctactgcaaggtgttgctgctgcacgaggtacatgccaacgacacaggcagctacgtctgctactacaagtacatcaaggcacgcatcgagggcaccacggccgccagctcctacgtgttcgtgagagactttgagcagccattcatcaacaagcctgacacgctcttggtcaacaggaaggacgccatgtgggtgccctgtctggtgtccatccccggcctcaatgtcacgctgcgctcgcaaagctcggtgctgtggccagacgggcaggaggtggtgtgggatgaccggcggggcatgctcgtgtccacgccactgctgcacgatgccctgtacctgcagtgcgagaccacctggggagaccaggacttcctttccaaccccttcctggtgcacatcacaggcaacgagctctatgacatccagctgttgcccaggaagtcgctggagctgctggtaggggagaagctggtcctgaactgcaccgtgtgggctgagtttaactcaggtgtcacctttgactgggactacccagggaagcaggcagagcggggtaagtgggtgcccgagcgacgctcccagcagacccacacagaactctccagcatcctgaccatccacaacgtcagccagcacgacctgggctcgtatgtgtgcaaggccaacaacggcatccagcgatttcgggagagcaccgaggtcattgtgcatgaaaatcccttcatcagcgtcgagtggctcaaaggacccatcctggaggccacggcaggagacgagctggtgaagctgcccgtgaagctggcagcgtaccccccgcccgagttccagtggtacaaggatggaaaggcactgtccgggcgccacagtccacatgccctggtgctcaaggaggtgacagaggccagcacaggcacctacaccctcgccctgtggaactccgctgctggcctgaggcgcaacatcagcctggagctggtggtgaatgtgcccccccagatacatgagaaggaggcctcctcccccagcatctactcgcgtcacagccgccaggccctcacctgcacggcctacggggtgcccctgcctctcagcatccagtggcactggcggccctggacaccctgcaagatgtttgcccagcgtagtctccggcggcggcagcagcaagacctcatgccacagtgccgtgactggagggcggtgaccacgcaggatgccgtgaaccccatcgagagcctggacacctggaccgagtttgtggagggaaagaataagactgtgagcaagctggtgatccagaatgccaacgtgtctgccatgtacaagtgtgtggtctccaacaaggtgggccaggatgagcggctcatctacttctatgtgaccaccatccccgacggcttcaccatcgaatccaagccatccgaggagctactagagggccagccggtgctcctgagctgccaagccgacagctacaagtacgagcatctgcgctggtaccgcctcaacctgtccacgctgcacgatgcgcacgggaacccgcttctgctcgactgcaagaacgtgcatctgttcgccacccctctggccgccagcctggaggaggtggcacctggggcgcgccacgccacgctcagcctgagtatcccccgcgtcgcgcccgagcacgagggccactatgtgtgcgaagtgcaagaccggcgcagccatgacaagcactgccacaagaagtacctgtcggtgcaggccctggaagcccctcggctcacgcagaacttgaccgacctcctggtgaacgtgagcgactcgctggagatgcagtgcttggtggccggagcgcacgcgcccagcatcgtgtggtacaaagacgagaggctgctggaggaaaagtctggagtcgacttggcggactccaaccagaagctgagcatccagcgcgtgcgcgaggaggatgcgggacgctatctgtgcagcgtgtgcaacgccaagggctgcgtcaactcctccgccagcgtggccgtggaaggctccgaggataagggcagcatggaggggtgcgtatccggtgacaccattgtaatgactagtggcggtccgcgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgaagatctgttaac

SEQ ID NO: 25 - DNA, 2567 bp, Artificial Sequence
  artificial construct relating to Homo Sapiens immunoglobulin
gttaacgaattcccaccatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaagcttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccgggtgcgtatccggtgacaccattgtaatgactagtggcggtccgcgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgaagatctgttaac

SEQ ID NO: 26 - DNA, 2588 bp, Artificial Sequence
  artificial construct relating to Homo Sapiens immunoglobulin
gttaacgaattcccaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacggggtgcgtatccggtgacaccattgtaatgactagtggcggtccgcgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgaagatctgttaac

SEQ ID NO: 27 - DNA, 2561 bp, Artificial Sequence
  artificial construct relating to Homo Sapiens immunoglobulin
gttaacgaattcccaccatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggagggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacagggtgcgtatccggtgacaccattgtaatgactagtggcggtccgcgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgaagatctgttaac

SEQ ID NO: 28 - DNA, 2585 bp, Artificial Sequence
  artificial construct relating to Homo Sapiens immunoglobulin
gttaacgaattcccaccatgaagccggcgacaggactttgggtctgggtgagccttctcgtggcggcggggaccgtccagcccagcgattctcagtcagtgtgtgcaggaacggagaataaactgagctctctctctgacctggaacagcagtaccgagccttgcgcaagtactatgaaaactgtgaggttgtcatgggcaacctggagataaccagcattgagcacaaccgggacctctccttcctgcggtctgttcgagaagtcacaggctacgtgttagtggctcttaatcagtttcgttacctgcctctggagaatttacgcattattcgtgggacaaaactttatgaggatcgatatgccttggcaatatttttaaactacagaaaagatggaaactttggacttcaagaacttggattaaagaacttgacagaaatcctaaatggtggagtctatgtagaccagaacaaattcctttgttatgcagacaccattcattggcaagatattgttcggaacccatggccttccaacttgactcttgtgtcaacaaatggtagttcaggatgtggacgttgccataagtcctgtactggccgttgctggggacccacagaaaatcattgccagactttgacaaggacggtgtgtgcagaacaatgtgacggcagatgctacggaccttacgtcagtgactgctgccatcgagaatgtgctggaggctgctcaggacctaaggacacagactgctttgcctgcatgaatttcaatgacagtggagcatgtgttactcagtgtccccaaacctttgtctacaatccaaccacctttcaactggagcacaatttcaatgcaaagtacacatatggagcattctgtgtcaagaaatgtccacataactttgtggtagattccagttcttgtgtgcgtgcctgccctagttccaagatggaagtagaagaaaatgggattaaaatgtgtaaaccttgcactgacatttgcccaaaagcttgtgatggcattggcacaggatcattgatgtcagctcagactgtggattccagtaacattgacaaattcataaactgtaccaagatcaatgggaatttgatctttctagtcactggtattcatggggacccttacaatgcaattgaagccatagacccagagaaactgaacgtctttcggacagtcagagagataacaggtttcctgaacatacagtcatggccaccaaacatgactgacttcagtgttttttctaacctggtgaccattggtggaagagtactctatagtggcctgtccttgcttatcctcaagcaacagggcatcacctctctacagttccagtccctgaaggaaatcagcgcaggaaacatctatattactgacaacagcaacctgtgttattatcataccattaactggacaacactcttcagcacaatcaaccagagaatagtaatccgggacaacagaaaagctgaaaattgtactgctgaaggaatggtgtgcaaccatctgtgttccagtgatggctgttggggacctgggccagaccaatgtctgtcgtgtcgccgcttcagtagaggaaggatctgcatagagtcttgtaacctctatgatggtgaatttcgggagtttgagaatggctccatctgtgtggagtgtgacccccagtgtgagaagatggaagatggcctcctcacatgccatggaccgggtcctgacaactgtacaaagtgctctcattttaaagatggcccaaactgtgtggaaaaatgtccagatggcttacagggggcaaacagtttcattttcaagtatgctgatccagatcgggagtgccacccatgccatccaaactgcacccaagggtgtaacggtcccactagtcatgactgcatttactacccatggacgggccattccactttaccacaacatgctagaactcccgggtgcgtatccggtgacaccattgtaatgactagtggcggtccgcgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgaagatctgttaac

SEQ ID NO: 29 - DNA, 785 bp, Artificial Sequence
  artificial construct relating to Homo Sapiens immunoglobulin
aagcttgaattcccaccatgctgctgctggcgagatgtctgctgctagtcctcgtctcctcgctgctggtatgctcgggactggcgtgtgacaaaactcacacatgcccaccgtgcccagcacctgaactcctgggggggccctcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 30 - DNA, 785 bp, Artificial Sequence
  artificial construct relating to Homo Sapiens immunoglobulin
aagcttgaattcccaccatggccttgacctttgctttactggtggccctcctggtgctcagctgcaagtcaagctgctctgtgggctgtgacaaaactcacacatgcccaccgtgcccagcacctgaactcctgggggggccctcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 31 - DNA, 767 bp, Artificial Sequence
  artificial construct relating to Homo Sapiens immunoglobulin
aagcttgaattcccaccatgctggctgccacagtcctgaccctggccctgctgggcaatgcccatgcctgtgacaaaactcacacatgcccaccgtgcccagcacctgaactcctgggggggccctcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 32 - protein, 251 aa, Artificial Sequence
  artificial construct relating to Homo Sapiens immunoglobulin
MLLLARCLLLVLVSSLLVCSGLACDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 33 - protein, 251 aa, Artificial Sequence
  artificial construct relating to Homo Sapiens immunoglobulin
MALTFALLVALLVLSCKSSCSVGCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 34 - protein, 245 aa, Artificial Sequence
  artificial construct relating to Homo Sapiens immunoglobulin
MLAATVLTLALLGNAHACDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 35 - protein, 228 aa, Artificial Sequence
  artificial construct relating to Homo Sapiens immunoglobulin
CDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36 - protein, 228 aa, Artificial Sequence
  artificial construct relating to Homo Sapiens immunoglobulin
  MOD_RES (1)..(1): amino acid having a S, Se,Te or Po  reactive functional group
  MOD_RES (7)..(7): cysteine or serine
  MOD_RES (10)..(10): cysteine or serine
XDKTHTXPPXPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 37 - protein, 222 aa, Artificial Sequence
  artificial construct relating to Homo Sapiens immunoglobulin
  MOD_RES (1)..(1): amino acid having a S, Se,Te or Po  reactive functional group
  MOD_RES (4)..(4): cysteine or serine
XPPXPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 38 - protein, 219 aa, Artificial Sequence
  artificial construct relating to Homo Sapiens immunoglobulin
CPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 39 - protein, 224 aa, Artificial Sequence
  artificial construct relating to Homo Sapiens immunoglobulin
PAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESC

SEQ ID NO: 40 - protein, 235 aa, Artificial Sequence
  artificial construct relating to Homo Sapiens immunoglobulin
  MOD_RES (224)..(224): cysteine or serine
  MOD_RES (235)..(235): amino acid having a S, Se,Te or Po  reactive functional group
  MOD_RES (235)..(235): amino acid having a S, Se,Te or Po  reactive functional group
PAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESXAEAQDGELDGX

SEQ ID NO: 41 - protein, 234 aa, Artificial Sequence
  artificial construct relating to Homo Sapiens immunoglobulin
  MOD_RES (1)..(1)
  MOD_RES (7)..(7): cysteine or serine
  MOD_RES (10)..(10): cysteine or serine
XDKTHTXPPXPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESC

SEQ ID NO: 42 - protein, 228 aa, Artificial Sequence
  artificial construct relating to Homo Sapiens immunoglobulin
  MOD_RES (1)..(1): amino acid having a S, Se,Te or Po  reactive functional group
  MOD_RES (4)..(4): cysteine or serine
XPPXPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESC

SEQ ID NO: 43 - protein, 225 aa, Artificial Sequence
  artificial construct relating to Homo Sapiens immunoglobulin
CPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESC

SEQ ID NO: 44 - protein, 245 aa, Artificial Sequence
  artificial construct relating to Homo Sapiens immunoglobulin
  MOD_RES (1)..(1): amino acid having a S, Se,Te or Po  reactive functional group
  MOD_RES (7)..(7): cysteine or serine
  MOD_RES (10)..(10): cysteine or serine
  MOD_RES (234)..(234): cysteine or serine
  MOD_RES (245)..(245): amino acid having a S, Se,Te or Po  reactive functional group
XDKTHTXPPXPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESXAEAQDGELDGX

SEQ ID NO: 45 - protein, 239 aa, Artificial Sequence
  artificial construct relating to Homo Sapiens immunoglobulin
  MOD_RES (1)..(1): amino acid having a S, Se,Te or Po  reactive functional group
  MOD_RES (4)..(4): cysteine or serine
  MOD_RES (228)..(228): cysteine or serine
  MOD_RES (239)..(239)
  MOD_RES (239)..(239): amino acid having a S, Se,Te or Po  reactive functional group
XPPXPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESXAEAQDGELDGX

SEQ ID NO: 46 - protein, 236 aa, Artificial Sequence
  artificial construct relating to Homo Sapiens immunoglobulin
  MOD_RES (225)..(225): cysteine or serine
  MOD_RES (236)..(236): amino acid having a S, Se,Te or Po  reactive functional group
CPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESXAEAQDGELDGX

SEQ ID NO: 47 - DNA, 776 bp, Artificial Sequence
  artificial construct relating to Homo Sapiens immunoglobulin
aagcttgaattcccaccatgctgctgctggcgagatgtctgctgctagtcctcgtctcctcgctgctggtatgctcgggactggcgtgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 48 - DNA, 776 bp, Artificial Sequence
  artificial construct relating to Homo Sapiens immunoglobulin
aagcttgaattcccaccatggccttgacctttgctttactggtggccctcctggtgctcagctgcaagtcaagctgctctgtgggctgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 49 - DNA, 758 bp, Artificial Sequence
  artificial construct relating to Homo Sapiens immunoglobulin
aagcttgaattcccaccatgctggctgccacagtcctgaccctggccctgctgggcaatgcccatgcctgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 50 - protein, 248 aa, Artificial Sequence
  artificial construct relating to Homo Sapiens immunoglobulin
MLLLARCLLLVLVSSLLVCSGLACCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 51 - protein, 248 aa, Artificial Sequence
  artificial construct relating to Homo Sapiens immunoglobulin
MALTFALLVALLVLSCKSSCSVGCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 52 - protein, 242 aa, Artificial Sequence
  artificial construct relating to Homo Sapiens immunoglobulin
MLAATVLTLALLGNAHACCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 53 - protein, 225 aa, Artificial Sequence
  artificial construct relating to Homo Sapiens immunoglobulin
CCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 54 - protein, 225 aa, Artificial Sequence
  artificial construct relating to Homo Sapiens immunoglobulin
  MOD_RES (1)..(1): amino acid having a S, Se,Te or Po  reactive functional group
  MOD_RES (2)..(2): cysteine or serine
  MOD_RES (5)..(5): cysteine or serine
  MOD_RES (8)..(8): cysteine or serine
XXVEXPPXPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 55 - protein, 224 aa, Artificial Sequence
  artificial construct relating to Homo Sapiens immunoglobulin
  MOD_RES (1)..(1): amino acid having a S, Se,Te or Po  reactive functional group
  MOD_RES (4)..(4): cysteine or serine
  MOD_RES (7)..(7): cysteine or serine
XVEXPPXPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 56 - protein, 221 aa, Artificial Sequence
  artificial construct relating to Homo Sapiens immunoglobulin
  MOD_RES (1)..(1): amino acid having a S, Se,Te or Po  reactive functional group
  MOD_RES (4)..(4): cysteine or serine
XPPXPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 57 - protein, 218 aa, Artificial Sequence
  artificial construct relating to Homo Sapiens immunoglobulin
CPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 58 - protein, 223 aa, Artificial Sequence
  artificial construct relating to Homo Sapiens immunoglobulin
PAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPELQLEESC

SEQ ID NO: 59 - protein, 234 aa, Artificial Sequence
  artificial construct relating to Homo Sapiens immunoglobulin
  MOD_RES (223)..(223): cysteine or serine
  MOD_RES (234)..(234): amino acid having a S, Se,Te or Po  reactive functional group
PAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPELQLEESXAEAQDGELDGX

SEQ ID NO: 60 - protein, 231 aa, Artificial Sequence
  artificial construct relating to Homo Sapiens immunoglobulin
  MOD_RES (1)..(1): amino acid having a S, Se,Te or Po  reactive functional group
  MOD_RES (2)..(2): cysteine or serine
  MOD_RES (5)..(5): cysteine or serine
  MOD_RES (8)..(8): cysteine or serine
XXVEXPPXPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPELQLEESC

SEQ ID NO: 61 - protein, 230 aa, Artificial Sequence
  artificial construct relating to Homo Sapiens immunoglobulin
  MOD_RES (1)..(1): amino acid having a S, Se,Te or Po  reactive functional group
  MOD_RES (4)..(4): cysteine or serine
  MOD_RES (7)..(7): cysteine or serine
XVEXPPXPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPELQLEESC

SEQ ID NO: 62 - protein, 227 aa, Artificial Sequence
  artificial construct relating to Homo Sapiens immunoglobulin
  MOD_RES (1)..(1): amino acid having a S, Se,Te or Po  reactive functional group
  MOD_RES (4)..(4): cysteine or serine
XPPXPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPELQLEESC

SEQ ID NO: 63 - protein, 224 aa, Artificial Sequence
  artificial construct relating to Homo Sapiens immunoglobulin
CPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPELQLEESC

SEQ ID NO: 64 - protein, 242 aa, Artificial Sequence
  artificial construct relating to Homo Sapiens immunoglobulin
  MOD_RES (1)..(1): amino acid having a S, Se,Te or Po  reactive functional group
  MOD_RES (2)..(2): cysteine or serine
  MOD_RES (5)..(5): cysteine or serine
  MOD_RES (8)..(8): cysteine or serine
  MOD_RES (231)..(231): cysteine or serine
  MOD_RES (242)..(242): amino acid having a S, Se,Te or Po  reactive functional group
XXVEXPPXPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPELQLEESXAEAQDGELDGX

SEQ ID NO: 65 - protein, 241 aa, Artificial Sequence
  artificial construct relating to Homo Sapiens immunoglobulin
  MOD_RES (1)..(1): amino acid having a S, Se,Te or Po  reactive functional group
  MOD_RES (4)..(4): cysteine or serine
  MOD_RES (7)..(7): cysteine or serine
  MOD_RES (230)..(230): cysteine or serine
  MOD_RES (241)..(241): amino acid having a S, Se,Te or Po  reactive functional group
XVEXPPXPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPELQLEESXAEAQDGELDGX

SEQ ID NO: 66 - protein, 238 aa, Artificial Sequence
  artificial construct relating to Homo Sapiens immunoglobulin
  MOD_RES (1)..(1): amino acid having a S, Se,Te or Po  reactive functional group
  MOD_RES (4)..(4): cysteine or serine
  MOD_RES (227)..(227): cysteine or serine
  MOD_RES (238)..(238): amino acid having a S, Se,Te or Po  reactive functional group
XPPXPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPELQLEESXAEAQDGELDGX

SEQ ID NO: 67 - protein, 235 aa, Artificial Sequence
  artificial construct relating to Homo Sapiens immunoglobulin
  MOD_RES (224)..(224): cysteine or serine
  MOD_RES (235)..(235): cysteine or serine
CPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPELQLEESXAEAQDGELDGX

SEQ ID NO: 68 - DNA, 902 bp, Artificial Sequence
  artificial construct relating to Homo Sapiens immunoglobulin
aagcttgaattcccaccatgctgctgctggcgagatgtctgctgctagtcctcgtctcctcgctgctggtatgctcgggactggcgtgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaatgactcgagcggccg

SEQ ID NO: 69 - DNA, 902 bp, Artificial Sequence
  artificial construct relating to Homo Sapiens immunoglobulin
aagcttgaattcccaccatggccttgacctttgctttactggtggccctcctggtgctcagctgcaagtcaagctgctctgtgggctgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaatgactcgagcggccg

SEQ ID NO: 70 - DNA, 884 bp, Artificial Sequence
  artificial construct relating to Homo Sapiens immunoglobulin
aagcttgaattcccaccatgctggctgccacagtcctgaccctggccctgctgggcaatgcccatgcctgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaatgactcgagcggccg

SEQ ID NO: 71 - protein, 290 aa, Artificial Sequence
  artificial construct relating to Homo Sapiens immunoglobulin
MLLLARCLLLVLVSSLLVCSGLACPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQFNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 72 - protein, 290 aa, Artificial Sequence
  artificial construct relating to Homo Sapiens immunoglobulin
MALTFALLVALLVLSCKSSCSVGCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQFNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 73 - protein, 284 aa, Artificial Sequence
  artificial construct relating to Homo Sapiens immunoglobulin
MLAATVLTLALLGNAHACPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQFNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 74 - protein, 267 aa, Artificial Sequence
  artificial construct relating to Homo Sapiens immunoglobulin
CPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQFNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 75 - protein, 267 aa, Artificial Sequence
  artificial construct relating to Homo Sapiens immunoglobulin
  MOD_RES (1)..(1): amino acid having a S, Se,Te or Po  reactive functional group
  MOD_RES (4)..(4): cysteine or serine
  MOD_RES (10)..(10): cysteine or serine
  MOD_RES (16)..(16): cysteine or serine
  MOD_RES (19)..(19): cysteine or serine
  MOD_RES (25)..(25): cysteine or serine
  MOD_RES (31)..(31): cysteine or serine
  MOD_RES (34)..(34): cysteine or serine
  MOD_RES (40)..(40): cysteine or serine
  MOD_RES (46)..(46): cysteine or serine
  MOD_RES (49)..(49): cysteine or serine
XPRXPEPKSXDTPPPXPRXPEPKSXDTPPPXPRXPEPKSXDTPPPXPRXPAPELLGGPSVFLFPPKPKDTLMISRTPEVTCVVVDVSHEDPEVQFKWYVDGVEVHNAKTKPREEQFNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 76 - protein, 264 aa, Artificial Sequence
  artificial construct relating to Homo Sapiens immunoglobulin
  MOD_RES (1)..(1): amino acid having a S, Se,Te or Po  reactive functional group
  MOD_RES (7)..(7): cysteine or serine
  MOD_RES (13)..(13): cysteine or serine
  MOD_RES (16)..(16): cysteine or serine
  MOD_RES (22)..(22): cysteine or serine
  MOD_RES (28)..(28): cysteine or serine
  MOD_RES (31)..(31): cysteine or serine
  MOD_RES (37)..(37): cysteine or serine
  MOD_RES (43)..(43): cysteine or serine
  MOD_RES (46)..(46): cysteine or serine
XPEPKSXDTPPPXPRXPEPKSXDTPPPXPRXPEPKSXDTPPPXPRXPAPELLGGPSVFLFPPKPKDTLMISRTPEVTCVVVDVSHEDPEVQFKWYVDGVEVHNAKTKPREEQFNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 77 - protein, 224 aa, Artificial Sequence
  artificial construct relating to Homo Sapiens immunoglobulin
PAPELLGGPSVFLFPPKPKDTLMISRTPEVTCVVVDVSHEDPEVQFKWYVDGVEVHNAKTKPREEQFNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPELQLEESC

SEQ ID NO: 78 - protein, 235 aa, Artificial Sequence
  artificial construct relating to Homo Sapiens immunoglobulin
  MOD_RES (224)..(224): cysteine or serine
  MOD_RES (235)..(235): amino acid having a S, Se,Te or Po  reactive functional group
PAPELLGGPSVFLFPPKPKDTLMISRTPEVTCVVVDVSHEDPEVQFKWYVDGVEVHNAKTKPREEQFNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPELQLEESXAEAQGDELDGX

SEQ ID NO: 79 - protein, 273 aa, Artificial Sequence
  artificial construct relating to Homo Sapiens immunoglobulin
  MOD_RES (1)..(1): amino acid having a S, Se,Te or Po  reactive functional group
  MOD_RES (4)..(4): cysteine or serine
  MOD_RES (10)..(10): cysteine or serine
  MOD_RES (16)..(16): cysteine or serine
  MOD_RES (19)..(19): cysteine or serine
  MOD_RES (25)..(25): cysteine or serine
  MOD_RES (31)..(31): cysteine or serine
  MOD_RES (34)..(34): cysteine or serine
  MOD_RES (40)..(40): cysteine or serine
  MOD_RES (46)..(46): cysteine or serine
  MOD_RES (49)..(49): cysteine or serine
XPRXPEPKSXDTPPPXPRXPEPKSXDTPPPXPRXPEPKSXDTPPPXPRXPAPELLGGPSVFLFPPKPKDTLMISRTPEVTCVVVDVSHEDPEVQFKWYVDGVEVHNAKTKPREEQFNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPELQLEESC

SEQ ID NO: 80 - protein, 270 aa, Artificial Sequence
  artificial construct relating to Homo Sapiens immunoglobulin
  MOD_RES (1)..(1): amino acid having a S, Se,Te or Po  reactive functional group
  MOD_RES (7)..(7): cysteine or serine
  MOD_RES (13)..(13): cysteine or serine
  MOD_RES (16)..(16): cysteine or serine
  MOD_RES (22)..(22): cysteine or serine
  MOD_RES (28)..(28): cysteine or serine
  MOD_RES (31)..(31): cysteine or serine
  MOD_RES (37)..(37): cysteine or serine
  MOD_RES (43)..(43): cysteine or serine
  MOD_RES (46)..(46): cysteine or serine
XPEPKSXDTPPPXPRXPEPKSXDTPPPXPRXPEPKSXDTPPPXPRXPAPELLGGPSVFLFPPKPKDTLMISRTPEVTCVVVDVSHEDPEVQFKWYVDGVEVHNAKTKPREEQFNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPELQLEESC

SEQ ID NO: 81 - protein, 284 aa, Artificial Sequence
  artificial construct relating to Homo Sapiens immunoglobulin
  MOD_RES (1)..(1): amino acid having a S, Se,Te or Po  reactive functional group
  MOD_RES (4)..(4): cysteine or serine
  MOD_RES (10)..(10): cysteine or serine
  MOD_RES (16)..(16): cysteine or serine
  MOD_RES (19)..(19): cysteine or serine
  MOD_RES (25)..(25): cysteine or serine
  MOD_RES (31)..(31): cysteine or serine
  MOD_RES (34)..(34): cysteine or serine
  MOD_RES (40)..(40): cysteine or serine
  MOD_RES (46)..(46): cysteine or serine
  MOD_RES (49)..(49): cysteine or serine
  MOD_RES (273)..(273): cysteine or serine
  MOD_RES (284)..(284): amino acid having a S, Se,Te or Po  reactive functional group
XPRXPEPKSXDTPPPXPRXPEPKSXDTPPPXPRXPEPKSXDTPPPXPRXPAPELLGGPSVFLFPPKPKDTLMISRTPEVTCVVVDVSHEDPEVQFKWYVDGVEVHNAKTKPREEQFNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPELQLEESXAEAQDGELDGX

SEQ ID NO: 82 - protein, 281 aa, Artificial Sequence
  artificial construct relating to Homo Sapiens immunoglobulin
  MOD_RES (1)..(1): amino acid having a S, Se,Te or Po  reactive functional group
  MOD_RES (7)..(7): cysteine or serine
  MOD_RES (13)..(13): cysteine or serine
  MOD_RES (16)..(16): cysteine or serine
  MOD_RES (22)..(22): cysteine or serine
  MOD_RES (28)..(28): cysteine or serine
  MOD_RES (31)..(31): cysteine or serine
  MOD_RES (37)..(37): cysteine or serine
  MOD_RES (43)..(43): cysteine or serine
  MOD_RES (46)..(46): cysteine or serine
  MOD_RES (270)..(270): cysteine or serine
  MOD_RES (281)..(281): amino acid having a S, Se,Te or Po  reactive functional group
XPEPKSXDTPPPXPRXPEPKSXDTPPPXPRXPEPKSXDTPPPXPRXPAPELLGGPSVFLFPPKPKDTLMISRTPEVTCVVVDVSHEDPEVQFKWYVDGVEVHNAKTKPREEQFNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPELQLEESXAEAQDGELDGX

SEQ ID NO: 83 - DNA, 767 bp, Artificial Sequence
  artificial construct relating to Homo Sapiens immunoglobulin
aagcttgaattcccaccatgctgctgctggcgagatgtctgctgctagtcctcgtctcctcgctgctggtatgctcgggactggcgtgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgactcgagcggccg

SEQ ID NO: 84 - DNA, 767 bp, Artificial Sequence
  artificial construct relating to Homo Sapiens immunoglobulin
aagcttgaattcccaccatggccttgacctttgctttactggtggccctcctggtgctcagctgcaagtcaagctgctctgtgggctgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgactcgagcggccg

SEQ ID NO: 85 - DNA, 749 bp, Artificial Sequence
  artificial construct relating to Homo Sapiens immunoglobulin
aagcttgaattcccaccatgctggctgccacagtcctgaccctggccctgctgggcaatgcccatgcctgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgactcgagcggccg

SEQ ID NO: 86 - protein, 245 aa, Artificial Sequence
  artificial construct relating to Homo Sapiens immunoglobulin
MLLLARCLLLVLVSSLLVCSGLACPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 87 - protein, 245 aa, Artificial Sequence
  artificial construct relating to Homo Sapiens immunoglobulin
MALTFALLVALLVLSCKSSCSVGCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 88 - protein, 239 aa, Artificial Sequence
  artificial construct relating to Homo Sapiens immunoglobulin
MLAATVLTLALLGNAHACPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 89 - protein, 222 aa, Artificial Sequence
  artificial construct relating to Homo Sapiens immunoglobulin
CPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 90 - protein, 222 aa, Artificial Sequence
  artificial construct relating to Homo Sapiens immunoglobulin
  MOD_RES (1)..(1): amino acid having a S, Se,Te or Po  reactive functional group
  MOD_RES (4)..(4): cysteine or serine
XPSXPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 91 - protein, 219 aa, Artificial Sequence
  artificial construct relating to Homo Sapiens immunoglobulin
CPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 92 - protein, 224 aa, Artificial Sequence
  artificial construct relating to Homo Sapiens immunoglobulin
PAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLELQLEESC

SEQ ID NO: 93 - protein, 235 aa, Artificial Sequence
  artificial construct relating to Homo Sapiens immunoglobulin
  MOD_RES (224)..(224): cysteine or serine
  MOD_RES (235)..(235): amino acid having a S, Se,Te or Po  reactive functional group
PAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLELQLEESXAEAQDGELDGX

SEQ ID NO: 94 - protein, 228 aa, Artificial Sequence
  artificial construct relating to Homo Sapiens immunoglobulin
  MOD_RES (1)..(1): amino acid having a S, Se,Te or Po  reactive functional group
  MOD_RES (4)..(4): cysteine or serine
XPSXPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLELQLEESC

SEQ ID NO: 95 - protein, 225 aa, Artificial Sequence
  artificial construct relating to Homo Sapiens immunoglobulin
CPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLELQLEESC

SEQ ID NO: 96 - protein, 239 aa, Artificial Sequence
  artificial construct relating to Homo Sapiens immunoglobulin
  MOD_RES (1)..(1): amino acid having a S, Se,Te or Po  reactive functional group
  MOD_RES (4)..(4): cysteine or serine
  MOD_RES (228)..(228): cysteine or serine
  MOD_RES (239)..(239): amino acid having a S, Se,Te or Po  reactive functional group
XPSXPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLELQLEESXAEAQDGELDGX

SEQ ID NO: 97 - protein, 236 aa, Artificial Sequence
  artificial construct relating to Homo Sapiens immunoglobulin
  MOD_RES (225)..(225): cysteine or serine
  MOD_RES (236)..(236): amino acid having a S, Se,Te or Po  reactive functional group
CPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLELQLEESXAEAQDGELDGX

SEQ ID NO: 98 - DNA, 767 bp, Artificial Sequence
  artificial construct relating to Homo Sapiens immunoglobulin
aagcttgaattcccaccatgctgctgctggcgagatgtctgctgctagtcctcgtctcctcgctgctggtatgctcgggactggcgtgcccaccgtgcccagcacctgaactcctgggggggccctcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 99 - DNA, 767 bp, Artificial Sequence
  artificial construct relating to Homo Sapiens immunoglobulin
aagcttgaattcccaccatggccttgacctttgctttactggtggccctcctggtgctcagctgcaagtcaagctgctctgtgggctgcccaccgtgcccagcacctgaactcctgggggggccctcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 100 - DNA, 749 bp, Artificial Sequence
  artificial construct relating to Homo Sapiens immunoglobulin
aagcttgaattcccaccatgctggctgccacagtcctgaccctggccctgctgggcaatgcccatgcctgcccaccgtgcccagcacctgaactcctgggggggccctcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 101 - protein, 245 aa, Artificial Sequence
  artificial construct relating to Homo Sapiens immunoglobulin
MLLLARCLLLVLVSSLLVCSGLACPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 102 - protein, 245 aa, Artificial Sequence
  artificial construct relating to Homo Sapiens immunoglobulin
MALTFALLVALLVLSCKSSCSVGCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 103 - protein, 239 aa, Artificial Sequence
  artificial construct relating to Homo Sapiens immunoglobulin
MLAATVLTLALLGNAHACPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 104 - protein, 222 aa, Artificial Sequence
  artificial construct relating to Homo Sapiens immunoglobulin
CPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 105 - protein, 228 aa, Artificial Sequence
  artificial construct relating to Homo Sapiens immunoglobulin
  MOD_RES (1)..(1): cysteine or selenocysteine
XDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 106 - DNA, 758 bp, Artificial Sequence
  artificial construct relating to Homo Sapiens immunoglobulin
aagcttgaattcccaccatgctgctgctggcgagatgtctgctgctagtcctcgtctcctcgctgctggtatgctcgggactggcgtgcccagcacctgaactcctgggggggccctcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 107 - DNA, 758 bp, Artificial Sequence
  artificial construct relating to Homo Sapiens immunoglobulin
aagcttgaattcccaccatggccttgacctttgctttactggtggccctcctggtgctcagctgcaagtcaagctgctctgtgggctgcccagcacctgaactcctgggggggccctcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 108 - DNA, 740 bp, Artificial Sequence
  artificial construct relating to Homo Sapiens immunoglobulin
aagcttgaattcccaccatgctggctgccacagtcctgaccctggccctgctgggcaatgcccatgcctgcccagcacctgaactcctgggggggccctcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 109 - protein, 242 aa, Artificial Sequence
  artificial construct relating to Homo Sapiens immunoglobulin
MLLLARCLLLVLVSSLLVCSGLACPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 110 - protein, 242 aa, Artificial Sequence
  artificial construct relating to Homo Sapiens immunoglobulin
MALTFALLVALLVLSCKSSCSVGCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 111 - protein, 236 aa, Artificial Sequence
  artificial construct relating to Homo Sapiens immunoglobulin
MLAATVLTLALLGNAHACPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 112 - protein, 219 aa, Artificial Sequence; identical to SEQ ID NO: 38
  artificial construct relating to Homo Sapiens immunoglobulin

SEQ ID NO: 113 - protein, 222 aa, Artificial Sequence
  artificial construct relating to Homo Sapiens immunoglobulin
  MOD_RES (1)..(1): cysteine or selenocysteine
XPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 114 - DNA, 1427 bp, Artificial Sequence
  artificial construct relating to Homo Sapiens immunoglobulin
aagcttgaattcccaccatgagctttccatgtaaatttgtagccagcttccttctgattttcaatgtttcttccaaaggtgcagtctccaaaactcacacatgcccaccgtgcccagcacctgaactcctgggggggccctcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccggagctgcaactggaggagagctgtgcggaggcgcaggacggggagctggacgggtgcgtatccggtgacaccattgtaatgactagtggcggtccgcgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgactcgagcggccg

SEQ ID NO: 115 - DNA, 1430 bp, Artificial Sequence
  artificial construct relating to Homo Sapiens immunoglobulin
aagcttgaattcccaccatgaaccggggagtcccttttaggcacttgcttctggtgctgcaactggcgctcctcccagcagccactcagggaaaaactcacacatgcccaccgtgcccagcacctgaactcctgggggggccctcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccggagctgcaactggaggagagctgtgcggaggcgcaggacggggagctggacgggtgcgtatccggtgacaccattgtaatgactagtggcggtccgcgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgactcgagcggccg

SEQ ID NO: 116 - protein, 465 aa, Artificial Sequence
  artificial construct relating to Homo Sapiens immunoglobulin
MSFPCKFVASFLLIFNVSSKGAVSKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESCAEAQDGELDGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 117 - protein, 466 aa, Artificial Sequence
  artificial construct relating to Homo Sapiens immunoglobulin
MNRGVPFRHLLLVLQLALLPAATQGKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESCAEAQDGELDGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 118 - protein, 441 aa, Artificial Sequence
  artificial construct relating to Homo Sapiens immunoglobulin
KTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESCAEAQDGELDGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 119 - protein, 242 aa, Artificial Sequence
  artificial construct relating to Homo Sapiens immunoglobulin
  THIOLEST (242)..(242): glycine-thioester
KTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESCAEAQDGELDX

SEQ ID NO: 120 - protein, 243 aa, Artificial Sequence
  artificial construct relating to Homo Sapiens immunoglobulin
  MOD_RES (243)..(243): cysteine or selenocysteine
KTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESCAEAQDGELDGX

SEQ ID NO: 121 - DNA, 800 bp, Artificial Sequence
  artificial construct relating to Homo Sapiens immunoglobulin
aagcttgaattcccaccatgagctttccatgtaaatttgtagccagcttccttctgattttcaatgtttcttccaaaggtgcagtctccaaaactcacacatgcccaccgtgcccagcacctgaactcctgggggggccctcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccggagctgcaactggaggagagctgttgactcgagcggccg

SEQ ID NO: 122 - DNA, 803 bp, Artificial Sequence
  artificial construct relating to Homo Sapiens immunoglobulin
aagcttgaattcccaccatgaaccggggagtcccttttaggcacttgcttctggtgctgcaactggcgctcctcccagcagccactcagggaaaaactcacacatgcccaccgtgcccagcacctgaactcctgggggggccctcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccggagctgcaactggaggagagctgttgactcgagcggccg

SEQ ID NO: 123 - protein, 256 aa, Artificial Sequence
  artificial construct relating to Homo Sapiens immunoglobulin
MSFPCKFVASFLLIFNVSSKGAVSKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESC

SEQ ID NO: 124 - protein, 257 aa, Artificial Sequence
  artificial construct relating to Homo Sapiens immunoglobulin
MNRGVPFRHLLLVLQLALLPAATQGKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESC

SEQ ID NO: 125 - protein, 232 aa, Artificial Sequence
  artificial construct relating to Homo Sapiens immunoglobulin
KTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESC

SEQ ID NO: 126 - protein, 466 aa, Artificial Sequence
  artificial construct relating to Homo Sapiens immunoglobulin
MLLLARCLLLVLVSSLLVCSGLACDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESCAEAQDGELDGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 127 - protein, 466 aa, Artificial Sequence
  artificial construct relating to Homo Sapiens immunoglobulin
MALTFALLVALLVLSCKSSCSVGCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESCAEAQDGELDGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 128 - protein, 460 aa, Artificial Sequence [sequence omitted]

SEQ ID NO: 129 - protein, 443 aa, Artificial Sequence
  artificial construct relating to Homo Sapiens immunoglobulin
CDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESCAEAQDGELDGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 130 - protein, 244 aa, Artificial Sequence
  artificial construct relating to Homo Sapiens immunoglobulin
  THIOLEST (244)..(244): glycine-thioester
CDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESCAEAQDGELDX

SEQ ID NO: 131 - protein, 245 aa, Artificial Sequence
  artificial construct relating to Homo Sapiens immunoglobulin
  MOD_RES (245)..(245): cysteine or selenocysteine
CDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESCAEAQDGELDGX

SEQ ID NO: 132 - protein, 460 aa, Artificial Sequence
  artificial construct relating to Homo Sapiens immunoglobulin
MLLLARCLLLVLVSSLLVCSGLACPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESCAEAQDGELDGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 133 - protein, 460 aa, Artificial Sequence
  artificial construct relating to Homo Sapiens immunoglobulin
MALTFALLVALLVLSCKSSCSVGCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESCAEAQDGELDGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 134 - protein, 454 aa, Artificial Sequence
  artificial construct relating to Homo Sapiens immunoglobulin
MLAATVLTLALLGNAHACPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESCAEAQDGELDGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 135 - protein, 437 aa, Artificial Sequence
  artificial construct relating to Homo Sapiens immunoglobulin
CPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESCAEAQDGELDGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 136 - protein, 443 aa, Artificial Sequence
  artificial construct relating to Homo Sapiens immunoglobulin
  MOD_RES (1)..(1): cysteine or selenocysteine
XDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESCAEAQDGELDGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 137 - protein, 244 aa, Artificial Sequence
  artificial construct relating to Homo Sapiens immunoglobulin
  MOD_RES (1)..(1): cysteine or selenocysteine
  THIOLEST (244)..(244): glycine-thioester
XDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESCAEAQDGELDX

SEQ ID NO: 138 - protein, 245 aa, Artificial Sequence
  artificial construct relating to Homo Sapiens immunoglobulin
  MOD_RES (1)..(1): cysteine or selenocysteine
  MOD_RES (245)..(245): cysteine or selenocysteine
XDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESCAEAQDGELDGX

SEQ ID NO: 139 - DNA, 1820 bp, Artificial Sequence
  artificial construct relating to Homo Sapiens immunoglobulin
aagcttgaattcccaccatgaaccggggagtcccttttaggcacttgcttctggtgctgcaactggcgctcctcccagcagccactcagggaaagaaagtggtgctgggcaaaaaaggggatacagtggaactgacctgtacagcttcccagaagaagagcatacaattccactggaaaaactccaaccagataaagattctgggaaatcagggctccttcttaactaaaggtccatccaagctgaatgatcgcgctgactcaagaagaagcctttgggaccaaggaaacttccccctgatcatcaagaatcttaagatagaagactcagatacttacatctgtgaagtggaggaccagaaggaggaggtgcaattgctagtgttcggattgactgccaactctgacacccacctgcttcaggggcagagcctgaccctgaccttggagagcccccctggtagtagcccctcagtgcaatgtaggagtccaaggggtaaaaacatacagggggggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagcttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccagggtgcgtatccggtgacaccattgtaatgactagtggcgggccccgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgactcgagcggccg

SEQ ID NO: 140 - protein, 596 aa, Artificial Sequence
  artificial construct relating to Homo Sapiens immunoglobulin
MNRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 141 - protein, 571 aa, Artificial Sequence
  artificial construct relating to Homo Sapiens immunoglobulin
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 142 - protein, 372 aa, Artificial Sequence
  artificial construct relating to Homo Sapiens immunoglobulin
  THIOLEST (372)..(372): glycine-thioester
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPX

SEQ ID NO: 143 - protein, 373 aa, Artificial Sequence
  artificial construct relating to Homo Sapiens immunoglobulin
  MOD_RES (373)..(373): cysteine or selenocysteine
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPGX

SEQ ID NO: 144 - DNA, 1364 bp, Artificial Sequence
  artificial construct relating to Homo Sapiens immunoglobulin
aagcttgaattcccaccatggcttgggtgtggaccttgcttttcctgatggcagctgcccaaagtatccaagcacagatccagttggtccagtctggacctgagctgaagaagcctggagagacagtcaagatctcctgcaaggcttcaggatataccttcacacactatggaatgaactgggtgaagcaggctccaggaaagggtttaaagtggatgggctggataaacacctacactggagagccaacatatgctgatgacttcaaggaacactttgccttctctttggaaacctctgccagcactgtctttttgcagatcaacaacctcaaaaatgaggacacggccacatatttctgtgcaagagaacggggggatgctatggactactggggtcagggaacctccgtcaccgtctcctcagcctccaccaaggggccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacagggtgcgtatccggtgacaccattgtaatgactagtggcgggccccgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgactcgagcggccg

SEQ ID NO: 145 - protein, 444 aa, Artificial Sequence
  artificial construct relating to Homo Sapiens immunoglobulin
MAWVWTLLFLMAAAQSIQAQIQLVQSGPELKKPGETVKISCKASGYTFTHYGMNWVKQAPGKGLKWMGWINTYTGEPTYADDFKEHFAFSLETSASTVFLQINNLKNEDTATYFCARERGDAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 146 - protein, 425 aa, Artificial Sequence
  artificial construct relating to Homo Sapiens immunoglobulin
QIQLVQSGPELKKPGETVKISCKASGYTFTHYGMNWVKQAPGKGLKWMGWINTYTGEPTYADDFKEHFAFSLETSASTVFLQINNLKNEDTATYFCARERGDAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 147 - protein, 226 aa, Artificial Sequence
  artificial construct relating to Homo Sapiens immunoglobulin
  THIOLEST (226)..(226): glycine-thioester
QIQLVQSGPELKKPGETVKISCKASGYTFTHYGMNWVKQAPGKGLKWMGWINTYTGEPTYADDFKEHFAFSLETSASTVFLQINNLKNEDTATYFCARERGDAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTX

SEQ ID NO: 148 - protein, 227 aa, Artificial Sequence
  artificial construct relating to Homo Sapiens immunoglobulin
  MOD_RES (227)..(227): cysteine or selenocysteine
QIQLVQSGPELKKPGETVKISCKASGYTFTHYGMNWVKQAPGKGLKWMGWINTYTGEPTYADDFKEHFAFSLETSASTVFLQINNLKNEDTATYFCARERGDAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGX

SEQ ID NO: 149 - DNA, 731 bp, Artificial Sequence
  artificial construct relating to Homo Sapiens immunoglobulin
aagcttgaattcccaccatgaagtcacagacccaggtcttcgtatttctactgctctgtgtgtctggtgctcatgggagtattgtgatgacccagactcccaaattcctgcttgtatcagcaggagacagggttaccataacctgcacggccagtcagagtgtgagtaatgatgtagtttggtaccaacagaagccagggcagtctcctaaaatgctgatgtattctgcattcaatcgctacactggagtccctgatcgtttcactggcagaggatacgggacggatttcactttcaccatcagctctgtgcaggctgaagacctggcagtttatttctgtcagcaggattataactctcctcggacgttcggtggaggcaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagtgactcgag

SEQ ID NO: 150 - protein, 234 aa, Artificial Sequence
  artificial construct relating to Homo Sapiens immunoglobulin
MKSQTQVFVFLLLCVSGAHGSIVMTQTPKFLLVSAGDRVTITCTASQSVSNDVVWYQQKPGQSPKMLMYSAFNRYTGVPDRFTGRGYGTDFTFTISSVQAEDLAVYFCQQDYNSPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 151 - protein, 214 aa, Artificial Sequence
  artificial construct relating to Homo Sapiens immunoglobulin
SIVMTQTPKFLLVSAGDRVTITCTASQSVSNDVVWYQQKPGQSPKMLMYSAFNRYTGVPDRFTGRGYGTDFTFTISSVQAEDLAVYFCQQDYNSPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 152 - DNA, 1268 bp, Artificial Sequence
  artificial construct relating to Homo Sapiens immunoglobulin
aagcttgaattcccaccatgggcctctccaccgtgcctgacctgctgctgccgctggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtggggtgcgtatccggtgacaccattgtaatgactagtggcgggccccgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgactcgagcggccg

SEQ ID NO: 153 - protein, 411 aa, Artificial Sequence
  artificial construct relating to Homo Sapiens immunoglobulin
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSGTTGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 154 - protein, 390 aa, Artificial Sequence
  artificial construct relating to Homo Sapiens immunoglobulin
IYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSGTTGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 155 - protein, 191 aa, Artificial Sequence
  artificial construct relating to Homo Sapiens immunoglobulin
  THIOLEST (191)..(191): glycine-thioester
IYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSGTTX

SEQ ID NO: 156 - protein, 192 aa, Artificial Sequence
  artificial construct relating to Homo Sapiens immunoglobulin
  MOD_RES (192)..(192): glycine-thioester
IYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSGTTGX

SEQ ID NO: 157 - DNA, 1403 bp, Artificial Sequence
  artificial construct relating to Homo Sapiens immunoglobulin
aagcttgaattcccaccatggcgcccgtcgccgtctgggccgcgctggccgtcggactggagctctgggctgcggcgcacgccttgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacgggtgcgtatccggtgacaccattgtaatgactagtggcgggccccgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgactcgagcggccg

SEQ ID NO: 158 - protein, 457 aa, Artificial Sequence
  artificial construct relating to Homo Sapiens immunoglobulin
MAPVAVWAALAVGLELWAAAHALPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 159 - protein, 435 aa, Artificial Sequence
  artificial construct relating to Homo Sapiens immunoglobulin
LPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 160 - protein, 236 aa, Artificial Sequence
  artificial construct relating to Homo Sapiens immunoglobulin
  THIOLEST (236)..(236): glycine-thioester
LPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDX

SEQ ID NO: 161 - protein, 237 aa, Artificial Sequence
  artificial construct relating to Homo Sapiens immunoglobulin
  MOD_RES (237)..(237): cysteine or selenocysteine
LPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDGX

SEQ ID NO: 162 - DNA, 1499 bp, Artificial Sequence
  artificial construct relating to Homo Sapiens immunoglobulin
aagcttgaattcccaccatggcgcccgtcgccgtctgggccgcgctggccgtcggactggagctctgggctgcggcgcacgccttgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacgagcccaaatcttgtgacaaaactcacacatgcccaccgtgcccagcacctgaactcctgggggggccctcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 163 - protein, 489 aa, Artificial Sequence
  artificial construct relating to Homo Sapiens immunoglobulin
MAPVAVWAALAVGLELWAAAHALPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 164 - protein, 467 aa, Artificial Sequence
  artificial construct relating to Homo Sapiens immunoglobulin
LPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 165 - DNA, 2906 bp, Artificial Sequence
  artificial construct relating to Homo Sapiens immunoglobulin
aagcttgaattcccaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacattagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctggaattattttaggaccaggaagcagcacgctgtttattgaaagagtcacagaagaggatgaaggtgtctatcactgcaaagccaccaaccagaagggctctgtggaaagttcagcatacctcactgttcaaggaacctcggacaagtctaatctggaggggtgcgtatccggtgacaccattgtaatgactagtggcgggccccgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgactcgagcggccg

SEQ ID NO: 166 - protein, 958 aa, Artificial Sequence [sequence omitted]

SEQ ID NO: 167 - protein, 932 aa, Artificial Sequence
  artificial construct relating to Homo Sapiens immunoglobulin
SKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLEGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 168 - protein, 733 aa, Artificial Sequence
  artificial construct relating to Homo Sapiens immunoglobulin
  THIOLEST (733)..(733): glycine-thioester
SKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLEX

SEQ ID NO: 169 - protein, 734 aa, Artificial Sequence
  artificial construct relating to Homo Sapiens immunoglobulin
  MOD_RES (734)..(734): cysteine or selenocysteine
SKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLEGX

SEQ ID NO: 170 - DNA, 2924 bp, Artificial Sequence
  artificial construct relating to Homo Sapiens immunoglobulin
aagcttgaattcccaccatgcagagcaaggtgctgctggccgtcgccctgtggctctgcgtggagacccgggccgcctctgtgggtttgcctagtgtttctcttgatctgcccaggctcagcatacaaaaagacatacttacaattaaggctaatacaactcttcaaattacttgcaggggacagagggacttggactggctttggcccaataatcagagtggcagtgagcaaagggtggaggtgactgagtgcagcgatggcctcttctgtaagacactcacaattccaaaagtgatcggaaatgacactggagcctacaagtgcttctaccgggaaactgacttggcctcggtcatttatgtctatgttcaagattacagatctccatttattgcttctgttagtgaccaacatggagtcgtgtacattactgagaacaaaaacaaaactgtggtgattccatgtctcgggtccatttcaaatctcaacgtgtcactttgtgcaagatacccagaaaagagatttgttcctgatggtaacagaatttcctgggacagcaagaagggctttactattcccagctacatgatcagctatgctggcatggtcttctgtgaagcaaaaattaatgatgaaagttaccagtctattatgtacatagttgtcgttgtagggtataggatttatgatgtggttctgagtccgtctcatggaattgaactatctgttggagaaaaacttgtcttaaattgtacagcaagaactgaactaaatgtggggattgacttcaactgggaatacccttcttcgaagcatcagcataagaaacttgtaaaccgagacctaaaaacccagtctgggagtgagatgaagaaatttttgagcaccttaactatagatggtgtaacccggagtgaccaaggattgtacacctgtgcagcatccagtgggctgatgaccaagaagaacagcacatttgtcagggtccatgaaaaaccttttgttgcttttggaagtggcatggaatctctggtggaagccacggtgggggagcgtgtcagaatccctgcgaagtaccttggttacccacccccagaaataaaatggtataaaaatggaataccccttgagtccaatcacacaattaaagcggggcatgtactgacgattatggaagtgagtgaaagagacacaggaaattacactgtcatccttaccaatcccatttcaaaggagaagcagagccatgtggtctctctggttgtgtatgtcccaccccagattggtgagaaatctctaatctctcctgtggattcctaccagtacggcaccactcaaacgctgacatgtacggtctatgccattcctcccccgcatcacatccactggtattggcagttggaggaagagtgcgccaacgagcccagccaagctgtctcagtgacaaacccatacccttgtgaagaatggagaagtgtggaggacttccagggaggaaataaaattgaagttaataaaaatcaatttgctctaattgaaggaaaaaacaaaactgtaagtacccttgttatccaagcggcaaatgtgtcagctttgtacaaatgtgaagcggtcaacaaagtcgggagaggagagagggtgatctccttccacgtgaccaggggtcctgaaattactttgcaacctgacatgcagcccactgagcaggagagcgtgtctttgtggtgcactgcagacagatctacgtttgagaacctcacatggtacaaacttggcccacagcctctgccaatccatgtgggagagttgcccacacctgtttgcaagaacttggatactctttggaaattgaatgccaccatgttctctaatagcacaaatgacattttgatcatggagcttaagaatgcatccttgcaggaccaaggagactatgtctgccttgctcaagacaggaagaccaagaaaagacattgcgtggtcaggcagctcacagtcctagagcgtgtggcacccacgatcacaggaaacctggagaatcagacgacaagtattggggaaagcatcgaagtctcatgcacggcatctgggaatccccctccacagatcatgtggtttaaagataatgagacccttgtagaagactcaggcattgtattgaaggatgggaaccggaacctcactatccgcagagtgaggaaggaggacgaaggcctctacacctgccaggcatgcagtgttcttggctgtgcaaaagtggaggcatttttcataatagaaggtgcccaggaaaagacgaacttggaagggtgcgtatccggtgacaccattgtaatgactagtggcgggccccgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgactcgagcggccg

SEQ ID NO: 171 - protein, 964 aa, Artificial Sequence
  artificial construct relating to Homo Sapiens immunoglobulin
MQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIEVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLERVAPTITGNLENQTTSIGESIEVSCTASGNPPPQIMWFKDNETLVEDSGIVLKDGNRNLTIRRVRKEDEGLYTCQACSVLGCAKVEAFFIIEGAQEKTNLEGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 172 - protein, 945 aa, Artificial Sequence
  artificial construct relating to Homo Sapiens immunoglobulin
ASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIEVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLERVAPTITGNLENQTTSIGESIEVSCTASGNPPPQIMWFKDNETLVEDSGIVLKDGNRNLTIRRVRKEDEGLYTCQACSVLGCAKVEAFFIIEGAQEKTNLEGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 173 - protein, 746 aa, Artificial Sequence
  artificial construct relating to Homo Sapiens immunoglobulin
  THIOLEST (746)..(746): glycine-thioester
ASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIEVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLERVAPTITGNLENQTTSIGESIEVSCTASGNPPPQIMWFKDNETLVEDSGIVLKDGNRNLTIRRVRKEDEGLYTCQACSVLGCAKVEAFFIIEGAQEKTNLEX

SEQ ID NO: 174 - protein, 747 aa, Artificial Sequence
  artificial construct relating to Homo Sapiens immunoglobulin
  MOD_RES (747)..(747): cysteine or selenocysteine
ASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIEVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLERVAPTITGNLENQTTSIGESIEVSCTASGNPPPQIMWFKDNETLVEDSGIVLKDGNRNLTIRRVRKEDEGLYTCQACSVLGCAKVEAFFIIEGAQEKTNLEGX

SEQ ID NO: 175 - DNA, 2957 bp, Artificial Sequence
  artificial construct relating to Homo Sapiens immunoglobulin
aagcttgaattcccaccatgcagcggggcgccgcgctgtgcctgcgactgtggctctgcctgggactcctggacggcctggtgagtggctactccatgacccccccgaccttgaacatcacggaggagtcacacgtcatcgacaccggtgacagcctgtccatctcctgcaggggacagcaccccctggagtgggcttggccaggagctcaggaggcgccagccaccggagacaaggacagcgaggacacgggggtggtgcgagactgcgagggcacagacgccaggccctactgcaaggtgttgctgctgcacgaggtacatgccaacgacacaggcagctacgtctgctactacaagtacatcaaggcacgcatcgagggcaccacggccgccagctcctacgtgttcgtgagagactttgagcagccattcatcaacaagcctgacacgctcttggtcaacaggaaggacgccatgtgggtgccctgtctggtgtccatccccggcctcaatgtcacgctgcgctcgcaaagctcggtgctgtggccagacgggcaggaggtggtgtgggatgaccggcggggcatgctcgtgtccacgccactgctgcacgatgccctgtacctgcagtgcgagaccacctggggagaccaggacttcctttccaaccccttcctggtgcacatcacaggcaacgagctctatgacatccagctgttgcccaggaagtcgctggagctgctggtaggggagaagctggtcctgaactgcaccgtgtgggctgagtttaactcaggtgtcacctttgactgggactacccagggaagcaggcagagcggggtaagtgggtgcccgagcgacgctcccagcagacccacacagaactctccagcatcctgaccatccacaacgtcagccagcacgacctgggctcgtatgtgtgcaaggccaacaacggcatccagcgatttcgggagagcaccgaggtcattgtgcatgaaaatcccttcatcagcgtcgagtggctcaaaggacccatcctggaggccacggcaggagacgagctggtgaagctgcccgtgaagctggcagcgtaccccccgcccgagttccagtggtacaaggatggaaaggcactgtccgggcgccacagtccacatgccctggtgctcaaggaggtgacagaggccagcacaggcacctacaccctcgccctgtggaactccgctgctggcctgaggcgcaacatcagcctggagctggtggtgaatgtgcccccccagatacatgagaaggaggcctcctcccccagcatctactcgcgtcacagccgccaggccctcacctgcacggcctacggggtgcccctgcctctcagcatccagtggcactggcggccctggacaccctgcaagatgtttgcccagcgtagtctccggcggcggcagcagcaagacctcatgccacagtgccgtgactggagggcggtgaccacgcaggatgccgtgaaccccatcgagagcctggacacctggaccgagtttgtggagggaaagaataagactgtgagcaagctggtgatccagaatgccaacgtgtctgccatgtacaagtgtgtggtctccaacaaggtgggccaggatgagcggctcatctacttctatgtgaccaccatccccgacggcttcaccatcgaatccaagccatccgaggagctactagagggccagccggtgctcctgagctgccaagccgacagctacaagtacgagcatctgcgctggtaccgcctcaacctgtccacgctgcacgatgcgcacgggaacccgcttctgctcgactgcaagaacgtgcatctgttcgccacccctctggccgccagcctggaggaggtggcacctggggcgcgccacgccacgctcagcctgagtatcccccgcgtcgcgcccgagcacgagggccactatgtgtgcgaagtgcaagaccggcgcagccatgacaagcactgccacaagaagtacctgtcggtgcaggccctggaagcccctcggctcacgcagaacttgaccgacctcctggtgaacgtgagcgactcgctggagatgcagtgcttggtggccggagcgcacgcgcccagcatcgtgtggtacaaagacgagaggctgctggaggaaaagtctggagtcgacttggcggactccaaccagaagctgagcatccagcgcgtgcgcgaggaggatgcgggacgctatctgtgcagcgtgtgcaacgccaagggctgcgtcaactcctccgccagcgtggccgtggaaggctccgaggataagggcagcatggaggggtgcgtatccggtgacaccattgtaatgactagtggcgggccccgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgactcgagcggccg

SEQ ID NO: 176 - protein, 975 aa, Artificial Sequence [sequence omitted]

SEQ ID NO: 177 - protein, 951 aa, Artificial Sequence
  artificial construct relating to Homo Sapiens immunoglobulin
YSMTPPTLNITEESHVIDTGDSLSISCRGQHPLEWAWPGAQEAPATGDKDSEDTGVVRDCEGTDARPYCKVLLLHEVHANDTGSYVCYYKYIKARIEGTTAASSYVFVRDFEQPFINKPDTLLVNRKDAMWVPCLVSIPGLNVTLRSQSSVLWPDGQEVVWDDRRGMLVSTPLLHDALYLQCETTWGDQDFLSNPFLVHITGNELYDIQLLPRKSLELLVGEKLVLNCTVWAEFNSGVTFDWDYPGKQAERGKWVPERRSQQTHTELSSILTIHNVSQHDLGSYVCKANNGIQRFRESTEVIVHENPFISVEWLKGPILEATAGDELVKLPVKLAAYPPPEFQWYKDGKALSGRHSPHALVLKEVTEASTGTYTLALWNSAAGLRRNISLELVVNVPPQIHEKEASSPSIYSRHSRQALTCTAYGVPLPLSIQWHWRPWTPCKMFAQRSLRRRQQQDLMPQCRDWRAVTTQDAVNPIESLDTWTEFVEGKNKTVSKLVIQNANVSAMYKCVVSNKVGQDERLIYFYVTTIPDGFTIESKPSEELLEGQPVLLSCQADSYKYEHLRWYRLNLSTLHDAHGNPLLLDCKNVHLFATPLAASLEEVAPGARHATLSLSIPRVAPEHEGHYVCEVQDRRSHDKHCHKKYLSVQALEAPRLTQNLTDLLVNVSDSLEMQCLVAGAHAPSIVWYKDERLLEEKSGVDLADSNQKLSIQRVREEDAGRYLCSVCNAKGCVNSSASVAVEGSEDKGSMEGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 178 - protein, 752 aa, Artificial Sequence
  artificial construct relating to Homo Sapiens immunoglobulin
  THIOLEST (752)..(752): glycine-thioester
YSMTPPTLNITEESHVIDTGDSLSISCRGQHPLEWAWPGAQEAPATGDKDSEDTGVVRDCEGTDARPYCKVLLLHEVHANDTGSYVCYYKYIKARIEGTTAASSYVFVRDFEQPFINKPDTLLVNRKDAMWVPCLVSIPGLNVTLRSQSSVLWPDGQEVVWDDRRGMLVSTPLLHDALYLQCETTWGDQDFLSNPFLVHITGNELYDIQLLPRKSLELLVGEKLVLNCTVWAEFNSGVTFDWDYPGKQAERGKWVPERRSQQTHTELSSILTIHNVSQHDLGSYVCKANNGIQRFRESTEVIVHENPFISVEWLKGPILEATAGDELVKLPVKLAAYPPPEFQWYKDGKALSGRHSPHALVLKEVTEASTGTYTLALWNSAAGLRRNISLELVVNVPPQIHEKEASSPSIYSRHSRQALTCTAYGVPLPLSIQWHWRPWTPCKMFAQRSLRRRQQQDLMPQCRDWRAVTTQDAVNPIESLDTWTEFVEGKNKTVSKLVIQNANVSAMYKCVVSNKVGQDERLIYFYVTTIPDGFTIESKPSEELLEGQPVLLSCQADSYKYEHLRWYRLNLSTLHDAHGNPLLLDCKNVHLFATPLAASLEEVAPGARHATLSLSIPRVAPEHEGHYVCEVQDRRSHDKHCHKKYLSVQALEAPRLTQNLTDLLVNVSDSLEMQCLVAGAHAPSIVWYKDERLLEEKSGVDLADSNQKLSIQRVREEDAGRYLCSVCNAKGCVNSSASVAVEGSEDKGSMEX

SEQ ID NO: 179 - protein, 753 aa, Artificial Sequence
  artificial construct relating to Homo Sapiens immunoglobulin
  MOD_RES (753)..(753): cysteine or selenocysteine
YSMTPPTLNITEESHVIDTGDSLSISCRGQHPLEWAWPGAQEAPATGDKDSEDTGVVRDCEGTDARPYCKVLLLHEVHANDTGSYVCYYKYIKARIEGTTAASSYVFVRDFEQPFINKPDTLLVNRKDAMWVPCLVSIPGLNVTLRSQSSVLWPDGQEVVWDDRRGMLVSTPLLHDALYLQCETTWGDQDFLSNPFLVHITGNELYDIQLLPRKSLELLVGEKLVLNCTVWAEFNSGVTFDWDYPGKQAERGKWVPERRSQQTHTELSSILTIHNVSQHDLGSYVCKANNGIQRFRESTEVIVHENPFISVEWLKGPILEATAGDELVKLPVKLAAYPPPEFQWYKDGKALSGRHSPHALVLKEVTEASTGTYTLALWNSAAGLRRNISLELVVNVPPQIHEKEASSPSIYSRHSRQALTCTAYGVPLPLSIQWHWRPWTPCKMFAQRSLRRRQQQDLMPQCRDWRAVTTQDAVNPIESLDTWTEFVEGKNKTVSKLVIQNANVSAMYKCVVSNKVGQDERLIYFYVTTIPDGFTIESKPSEELLEGQPVLLSCQADSYKYEHLRWYRLNLSTLHDAHGNPLLLDCKNVHLFATPLAASLEEVAPGARHATLSLSIPRVAPEHEGHYVCEVQDRRSHDKHCHKKYLSVQALEAPRLTQNLTDLLVNVSDSLEMQCLVAGAHAPSIVWYKDERLLEEKSGVDLADSNQKLSIQRVREEDAGRYLCSVCNAKGCVNSSASVAVEGSEDKGSMEGX

SEQ ID NO: 180 - DNA, 2567 bp, Artificial Sequence
  artificial construct relating to Homo Sapiens immunoglobulin
aagcttgaattcccaccatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaatccctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggtccggagcccagggactgcgtctcttgccggaatgtcagccgaggcagggaatgcgtggacaagtgcaagctcctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccgggtgcgtatccggtgacaccattgtaatgactagtggcgggccccgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgactcgagcggccg

SEQ ID NO: 181 - protein, 845 aa, Artificial Sequence
  artificial construct relating to Homo Sapiens immunoglobulin
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 182 - protein, 821 aa, Artificial Sequence
  artificial construct relating to Homo Sapiens immunoglobulin
LEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 183 - protein, 622 aa, Artificial Sequence
  artificial construct relating to Homo Sapiens immunoglobulin
  THIOLEST (622)..(622): glycine-thioester
LEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSX

SEQ ID NO: 184 - protein, 623 aa, Artificial Sequence
  artificial construct relating to Homo Sapiens immunoglobulin
  MOD_RES (623)..(623): cysteine or selenocysteine
LEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSGX

SEQ ID NO: 185 - DNA, 2588 bp, Artificial Sequence
  artificial construct relating to Homo Sapiens immunoglobulin
aagcttgaattcccaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggtcccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccaggtcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacggggtgcgtatccggtgacaccattgtaatgactagtggcgggccccgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgactcgagcggccg

SEQ ID NO: 186 - protein, 852 aa, Artificial Sequence
  artificial construct relating to Homo Sapiens immunoglobulin
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 187 - protein, 830 aa, Artificial Sequence
  artificial construct relating to Homo Sapiens immunoglobulin
TQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 188 - protein, 631 aa, Artificial Sequence
  artificial construct relating to Homo Sapiens immunoglobulin
  THIOLEST (631)..(631): glycine-thioester
TQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTX

SEQ ID NO: 189 - protein, 632 aa, Artificial Sequence
  artificial construct relating to Homo Sapiens immunoglobulin
  MOD_RES (632)..(632): cysteine or selenocysteine
TQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTGX

SEQ ID NO: 190 - DNA, 2561 bp, Artificial Sequence
  artificial construct relating to Homo Sapiens immunoglobulin
aagcttgaattcccaccatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattttctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctctgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttggtcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggattcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctgggtcccaggccctggtcagtgcttgtcctgtcgaaattatagccgaggaggtgtctgtgtgacccactgcaactttctgaatggggagccgcgagaatttgcccatgaggccgaatgcttctcctgccacccggaatgccaacccatggagggcactgccacatgcaatggctcgggctctgatacttgtgctcaatgtgcccattttcgagatggtccccactgtgtgagcagctgcccccatggagtcctaggtgccaagggtccaatctacaagtacccagatgttcagaatgaatgtcggccctgccatgagaactgcacccaggggtgtaaaggaccagagcttcaagactgtttaggacaaacactggtgctgatcggcaaaacccatctgacagggtgcgtatccggtgacaccattgtaatgactagtggcgggccccgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgactcgagcggccg

SEQ ID NO: 191 - protein, 843 aa, Artificial Sequence
  artificial construct relating to Homo Sapiens immunoglobulin
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 192 - protein, 824 aa, Artificial Sequence
  artificial construct relating to Homo Sapiens immunoglobulin
SEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 193 - protein, 625 aa, Artificial Sequence
  artificial construct relating to Homo Sapiens immunoglobulin
  THIOLEST (625)..(625): glycine-thioester
SEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTX

SEQ ID NO: 194 - protein, 626 aa, Artificial Sequence
  artificial construct relating to Homo Sapiens immunoglobulin
  MOD_RES (626)..(626): cysteine or selenocysteine
SEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTGX

SEQ ID NO: 195 - DNA, 2585 bp, Artificial Sequence
  artificial construct relating to Homo Sapiens immunoglobulin
aagcttgaattcccaccatgaagccggcgacaggactttgggtctgggtgagccttctcgtggcggcggggaccgtccagcccagcgattctcagtcagtgtgtgcaggaacggagaataaactgagctctctctctgacctggaacagcagtaccgagccttgcgcaagtactatgaaaactgtgaggttgtcatgggcaacctggagataaccagcattgagcacaaccgggacctctccttcctgcggtctgttcgagaagtcacaggctacgtgttagtggctcttaatcagtttcgttacctgcctctggagaatttacgcattattcgtgggacaaaactttatgaggatcgatatgccttggcaatatttttaaactacagaaaagatggaaactttggacttcaagaacttggattaaagaacttgacagaaatcctaaatggtggagtctatgtagaccagaacaaattcctttgttatgcagacaccattcattggcaagatattgttcggaacccatggccttccaacttgactcttgtgtcaacaaatggtagttcaggatgtggacgttgccataagtcctgtactggccgttgctggggacccacagaaaatcattgccagactttgacaaggacggtgtgtgcagaacaatgtgacggcagatgctacggaccttacgtcagtgactgctgccatcgagaatgtgctggaggctgctcaggacctaaggacacagactgctttgcctgcatgaatttcaatgacagtggagcatgtgttactcagtgtccccaaacctttgtctacaatccaaccacctttcaactggagcacaatttcaatgcaaagtacacatatggagcattctgtgtcaagaaatgtccacataactttgtggtagattccagttcttgtgtgcgtgcctgccctagttccaagatggaagtagaagaaaatgggattaaaatgtgtaaaccttgcactgacatttgcccaaaggcttgtgatggcattggcacaggatcattgatgtcagctcagactgtggattccagtaacattgacaaattcataaactgtaccaagatcaatgggaatttgatctttctagtcactggtattcatggggacccttacaatgcaattgaagccatagacccagagaaactgaacgtctttcggacagtcagagagataacaggtttcctgaacatacagtcatggccaccaaacatgactgacttcagtgttttttctaacctggtgaccattggtggaagagtactctatagtggcctgtccttgcttatcctcaagcaacagggcatcacctctctacagttccagtccctgaaggaaatcagcgcaggaaacatctatattactgacaacagcaacctgtgttattatcataccattaactggacaacactcttcagcacaatcaaccagagaatagtaatccgggacaacagaaaagctgaaaattgtactgctgaaggaatggtgtgcaaccatctgtgttccagtgatggctgttggggacctgggccagaccaatgtctgtcgtgtcgccgcttcagtagaggaaggatctgcatagagtcttgtaacctctatgatggtgaatttcgggagtttgagaatggctccatctgtgtggagtgtgacccccagtgtgagaagatggaagatggcctcctcacatgccatggaccgggtcctgacaactgtacaaagtgctctcattttaaagatggcccaaactgtgtggaaaaatgtccagatggcttacagggggcaaacagtttcattttcaagtatgctgatccagatcgggagtgccacccatgccatccaaactgcacccaagggtgtaacggtcccactagtcatgactgcatttactacccatggacgggccattccactttaccacaacatgctagaactcccgggtgcgtatccggtgacaccattgtaatgactagtggcgggccccgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgactcgagcggccg

SEQ ID NO: 196 - protein, 851 aa, Artificial Sequence
  artificial construct relating to Homo Sapiens immunoglobulin
MKPATGLWVWVSLLVAAGTVQPSDSQSVCAGTENKLSSLSDLEQQYRALRKYYENCEVVMGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCGRCHKSCTGRCWGPTENHCQTLTRTVCAEQCDGRCYGPYVSDCCHRECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACDGIGTGSLMSAQTVDSSNIDKFINCTKINGNLIFLVTGIHGDPYNAIEAIDPEKLNVFRTVREITGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCNGPTSHDCIYYPWTGHSTLPQHARTPGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 197 - protein, 826 aa, Artificial Sequence
  artificial construct relating to Homo Sapiens immunoglobulin
QSVCAGTENKLSSLSDLEQQYRALRKYYENCEVVMGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCGRCHKSCTGRCWGPTENHCQTLTRTVCAEQCDGRCYGPYVSDCCHRECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACDGIGTGSLMSAQTVDSSNIDKFINCTKINGNLIFLVTGIHGDPYNAIEAIDPEKLNVFRTVREITGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCNGPTSHDCIYYPWTGHSTLPQHARTPGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 198 - protein, 627 aa, Artificial Sequence
  artificial construct relating to Homo Sapiens immunoglobulin
  THIOLEST (627)..(627): glycine-thioester
QSVCAGTENKLSSLSDLEQQYRALRKYYENCEVVMGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCGRCHKSCTGRCWGPTENHCQTLTRTVCAEQCDGRCYGPYVSDCCHRECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACDGIGTGSLMSAQTVDSSNIDKFINCTKINGNLIFLVTGIHGDPYNAIEAIDPEKLNVFRTVREITGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCNGPTSHDCIYYPWTGHSTLPQHARTPX

SEQ ID NO: 199 - protein, 628 aa, Artificial Sequence
  artificial construct relating to Homo Sapiens immunoglobulin
  MOD_RES (628)..(628): cysteine or selenocysteine
QSVCAGTENKLSSLSDLEQQYRALRKYYENCEVVMGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCGRCHKSCTGRCWGPTENHCQTLTRTVCAEQCDGRCYGPYVSDCCHRECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACDGIGTGSLMSAQTVDSSNIDKFINCTKINGNLIFLVTGIHGDPYNAIEAIDPEKLNVFRTVREITGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCNGPTSHDCIYYPWTGHSTLPQHARTPGX

What is claimed is:

1. A process of making a product comprising:
a) transfecting a cell with a recombinant nucleic acid which encodes a chimeric polypeptide comprising, from its N terminus to its C terminus,
  (i) an N-terminal signal sequence, contiguous with
  (ii) such stretch of consecutive amino acids capable of forming a disulfide bond, contiguous with
  (iii) a C-terminal intein-containing binding domain, under conditions such that:
  (i) the cell expresses the chimeric polypeptide;
  (ii) the N-terminal signal sequence is cleaved from the chimeric polypeptide, so as to produce a second chimeric polypeptide comprising the stretch of consecutive amino acids that is capable of forming a disulfide bond contiguous with the C-terminal intein-containing binding domain; and
  (iii) the cell secretes the second chimeric polypeptide,
b) isolating the secreted second chimeric polypeptide produced in step (a);
c) treating the second chimeric polypeptide from step (b) with a cysteine or selenocysteine, so as to cause:
  (i) thio-mediated cleavage of the C-terminal intein-containing binding domain from the stretch of consecutive amino acids; and
  (ii) ligation of the cysteine or selenocysteine to such stretch of consecutive amino acids within such second chimeric polypeptide, at the C-terminal side thereof;
d) recovering the product of step (c) which is the stretch of consecutive amino acids comprising at its C-terminal side the additional cysteine or selenocysteine, and
e) then either:
  (i) combining the product recovered in step (d) with a second product made using the process of steps (a)-(d) under conditions resulting in the formation of an —S—S—, —S—Se—, —Se—Se—, or —Se—S— bond between the respective C-terminal residues of the first product and the second product;
  (ii) combining the product recovered in step (d) with a second, different stretch of consecutive amino acids comprising an N-terminal S-terminus or Se-terminus, under conditions resulting in the formation of an —S—S—, —S—Se—, —Se—Se—, or —Se—S— bond between the C terminus of the product and the N-terminal S-terminus or Se-terminus of the second, different stretch of consecutive amino acids; or
  (iii) combining the product recovered in step (d) with a solid surface under conditions resulting in attachment of the product to such surface at its C-terminus, wherein the attachment is mediated by an —S—S—, —S—Se—, —Se—Se—, or —Se—S— bond formed between the cysteine or selenocysteine of the product and a cysteine or selenocysteine of the solid surface.

2. The process of claim 1 comprising step (e)(i).

3. The process of claim 2, wherein the first product and the second product are identical.

4. The process of claim 2, wherein the first product and the second product are different.

5. The process of claim 2, wherein the conditions resulting in the formation of an —S—S—, —S—Se—, —Se—Se—, or —Se—S— bond are oxidizing conditions.

6. The process of claim 2, wherein the conditions resulting in the formation of an —S—S—, —S—Se—, —Se—Se—, or —Se—S— bond are reducing conditions.

7. The process of claim 2, wherein a buffer of 0.1 M $K_2HPO_4$ creates the conditions resulting in the formation of the —S—S—, —S—Se—, —Se—Se—, or —Se—S— bond.

8. The process of claim 1 comprising step (e)(ii).

9. The process of claim 8 wherein the second, different stretch of consecutive amino acids comprises an Fc domain.

10. The process of claim 1 comprising step (e)(iii).

11. A process of making a product comprising:
a) co-transfecting a cell with:
  (i) a recombinant nucleic acid which encodes a chimeric polypeptide comprising from its N terminus to its C terminus,
    (a) an N-terminal signal sequence, contiguous with
    (b) the Vk-Ck protein; and
  (ii) a recombinant nucleic acid which encodes a chimeric polypeptide comprising, from its N terminus to its C terminus,
    (a) an N-terminal signal sequence, contiguous with
    (b) the VH-CH protein, contiguous with
    (c) a C-terminal intein-containing binding domain, under conditions such that:
    (i) the cell expresses each chimeric polypeptide;
    (ii) the N-terminal signal sequence of each chimeric polypeptide is cleaved;
    (iii) the cell secretes the Vk-Ck protein and the VH-CH contiguous with the C-terminal intein-containing binding domain; and
    (iv) a disulfide bond is formed between the VH-CH protein and the Vk-Ck protein,
b) isolating the secreted product of step (a);
c) treating the isolated product from step (b) with a cysteine or selenocysteine so as to cause:
  (i) thio-mediated cleavage of the C-terminal intein-containing binding domain from the stretch of consecutive amino acids; and (ii) ligation of the cysteine or selenocysteine, to such stretch of consecutive amino acids within such second chimeric polypeptide, at the C-terminal side thereof;

d) recovering the product of step (c); and e) then either:
  (i) combining the product recovered in step (d) with a second product made using the process of steps (a)-(d), under conditions resulting in the formation of an —S—S—, —S—Se—, —Se—Se—, or —Se—S— bond between the respective C-terminal residues of the VH-CH component of the first product and the second product;
  (ii) combining the product recovered in step (d) with a second, different stretch of consecutive amino acids comprising an N-terminal S-terminus or Se-terminus, under conditions resulting in the formation of an —S—S—, —S—Se—, —Se—Se—, or —Se—S— bond between the C terminus of the product and the N-terminal S-terminus or Se-terminus of the second, different stretch of consecutive amino acids; or
  (iii) combining the product recovered in step (d) with a solid surface under conditions resulting in attachment of the protein to such surface at its C-terminus, wherein the attachment is mediated by an —S—S—, —S—Se—, —Se—Se—, or —Se—S— bond formed between the cysteine or selenocysteine of the product and a cysteine or selenocysteine of the solid surface.

12. The process of claim 11 comprising step (e)(i).

13. The process of claim 12, wherein the first product and the second product are identical.

14. The process of claim 12, wherein the first product and the second product are different.

15. The process of claim 12, wherein the conditions resulting in the formation of an —S—S—, —S—Se—, —Se—Se—, or —Se—S— bond are oxidizing conditions.

16. The process of claim 12, wherein the conditions resulting in the formation of an —S—S—, —S—Se—, —Se—Se—, or —Se—S— bond are reducing conditions.

17. The process of claim 12, wherein a buffer of 0.1 M $K_2PO_4$ creates the conditions resulting in the formation of the —S—S—, —S—Se—, —Se—Se—, or —Se—S— bond.

18. The process of claim 11 comprising step (e)(ii).

19. The process of claim 11 comprising step (e)(iii).

* * * * *